United States Patent
Brandon et al.

(10) Patent No.: US 10,865,447 B2
(45) Date of Patent: Dec. 15, 2020

(54) BIOMARKER SIGNATURE METHOD, AND APPARATUS AND KITS THEREFOR

(71) Applicant: ImmuneXpress Pty Ltd, Boonah (AU)

(72) Inventors: Richard Bruce Brandon, Boonah (AU); Leo Charles McHugh, Seattle, WA (US)

(73) Assignee: ImmuneXpress Pty Ltd, Boonah (AU)

( * ) Notice: Subject to any disclaimer, the term of this patent is extended or adjusted under 35 U.S.C. 154(b) by 0 days.

(21) Appl. No.: 14/714,188

(22) Filed: May 15, 2015

(65) Prior Publication Data
US 2015/0259746 A1  Sep. 17, 2015

Related U.S. Application Data

(62) Division of application No. 14/616,565, filed on Feb. 6, 2015.

(30) Foreign Application Priority Data

Feb. 6, 2014 (AU) ............... 2014900363

(51) Int. Cl.
*C12Q 1/6883* (2018.01)
*G16B 25/00* (2019.01)
*G16B 40/00* (2019.01)

(52) U.S. Cl.
CPC ......... *C12Q 1/6883* (2013.01); *G16B 25/00* (2019.02); *C12Q 2600/118* (2013.01); *C12Q 2600/16* (2013.01); *G16B 40/00* (2019.02)

(58) Field of Classification Search
None
See application file for complete search history.

(56) References Cited

U.S. PATENT DOCUMENTS

| | | |
|---|---|---|
| 2003/0219760 A1 | 11/2003 | Gordon et al. |
| 2004/0096917 A1 | 5/2004 | Ivey et al. |
| 2004/0097460 A1 | 5/2004 | Ivey et al. |
| 2006/0019256 A1 | 1/2006 | Clarke et al. |
| 2006/0246495 A1 | 11/2006 | Garrett et al. |
| 2007/0105133 A1* | 5/2007 | Clarke ............... C12N 5/0693 435/6.12 |
| 2007/0134261 A1 | 6/2007 | Hancock et al. |
| 2007/0154931 A1* | 7/2007 | Radich ............... C12Q 1/6886 435/6.11 |
| 2008/0070235 A1 | 3/2008 | Russwurm et al. |
| 2008/0286763 A1 | 11/2008 | Russwurm et al. |
| 2009/0203534 A1 | 8/2009 | Hossain et al. |
| 2010/0028876 A1 | 2/2010 | Gordon et al. |
| 2011/0076685 A1 | 3/2011 | Moeller et al. |
| 2011/0098195 A1 | 4/2011 | Russwurm |
| 2011/0312521 A1 | 12/2011 | Chaussabel |
| 2012/0082659 A1 | 4/2012 | Land et al. |
| 2014/0037649 A1 | 2/2014 | Brandon et al. |
| 2015/0218640 A1 | 8/2015 | Brandon et al. |
| 2015/0315643 A1* | 11/2015 | O'Garra ............... C12Q 1/6883 506/2 |
| 2016/0055295 A1 | 2/2016 | Brandon et al. |
| 2016/0237493 A1 | 8/2016 | Brandon et al. |
| 2016/0312286 A1 | 10/2016 | Brandon et al. |
| 2017/0191129 A1 | 7/2017 | Brandon et al. |

FOREIGN PATENT DOCUMENTS

| | | |
|---|---|---|
| WO | WO 99/45398 A1 | 9/1999 |
| WO | WO 2006/042192 A2 | 4/2006 |
| WO | WO 2007/060647 A2 | 5/2007 |
| WO | WO 2007/130831 A2 | 11/2007 |
| WO | WO 2010/083252 A2 | 7/2010 |
| WO | WO 2011/003905 A1 | 1/2011 |
| WO | WO 2012/068642 A1 | 5/2012 |
| WO | WO 2013/040379 A1 | 3/2013 |
| WO | WO 2014/201516 A2 | 4/2014 |
| WO | WO 2015/117204 A1 | 8/2015 |

OTHER PUBLICATIONS

Tang et al. (Crit Care Med 2009 vol. 37 p. 882).*
Affymetrix Gene chip U133 plus 2.0 (www.affymetrix.com).*
Bertolini (journal of virological methods 2001 vol. 96 p. 33).*
Pankka, R., et al., "Genomic Transcriptional Profiling Identifies a Candidate Blood Biomarker Signature for the Diagnosis of Septicemic Melioidosis," Genome Biology 2009, vol. 10, Issue 11, Article R127, 22 pages.
"Introduction to TaqMan® and SYBR® Green Chemistries for Real-Time PCR." Applied Biosystems (2010); 17 pages.
"TaqMan® Gene Expression Assays." Applied Biosystems (2010); 69 pages.
Benjamini and Hochberg, Journal of the Royal Statistical Society. Series B (Methodological) 57.1: 289-300 (1995).
Clarke, Michael F., et al. "Cancer stem cells—perspectives on current status and future directions: AACR Workshop on cancer stem cells." Cancer Research (2006); 66.19: 9339-9344.
dos Anjos Pultz et al., "Far Beyond the Usual Biomarkers in Breast Cancer: A Review." J. Cancer 5, 559-571 (2016).
International Search Report and Written Opinion for International Application No. PCT/AU2015/050043, dated Apr. 23, 2015, 17 pages.
International Spreliminary Report on Patentability for International Application No. PCT/AU2015/050043, dated Mar. 22, 2016, 100 pages.

(Continued)

*Primary Examiner* — Katherine D Salmon

(57) ABSTRACT

The present invention discloses methods, kits, and apparatus as well as reagents and compositions associated therewith for deriving an indicator for use in diagnosing the presence, absence or degree of at least one condition in a biological subject or in prognosing at least one condition in a biological subject. Also disclosed is a biomarker signature for use in diagnosing the presence, absence or degree of at least one condition in a biological subject or in prognosing at least one condition in a biological subject. The present invention further discloses methods, kits and apparatus, as well as reagents and compositions associated therewith, for identifying biomarkers for use in a biomarker signature.

1 Claim, 37 Drawing Sheets
Specification includes a Sequence Listing.

(56) References Cited

OTHER PUBLICATIONS

Liu et al., "Gene Expression Omnibus (GEO), GEO2R Analysis of Dataset GSE6883." The prognistic role of a gene signature from tumorigenic breast-cancer cells. (Summary and Tables) Engl. J. Med. 356.3: 217-226 (2007). PMID: 17229949.

Liu, Rui, et al. "The prognostic role of a gene signature from tumorigenic breast-cancer cells." New England Journal of Medicine (2007); 356.3: 217-226.

Markoulatos, P., et al. "Multiplex polymerase chain reaction: a practical approach." Journal of Clinical Laboratory Analysis (2002); 16.1: 47-51.

McHugh, Leo, et al. "A molecular host response assay to discriminate between sepsis and infection-negative systemic inflammation in critically ill patients: discovery and validation in independent cohorts." PLoS Med (2015); 12.12: e1001916, 35 pages.

Perkel, J.M. "Overcoming the Challenges of Multiplex PCR." www.biocompare.com/Editorial-Articles/117895-Multiplex-PCR, Oct. 23, 2012, 4 pages.

Ramilo, Octavio, et al. "Gene expression patterns in blood leukocytes discriminate patients with acute infections." Blood (2007); 109.5: 2066-2077, and Supplemental Material.

Reinhart, Konrad et al., "New Approaches to Sepsis: Molecular Diagnostics and Biomarkers." Clinical Microbiology Reviews (2012); 25(4): 609-634.

Sweeney, Timothy E., et al. "A comprehensive time-course—based multicohort analysis of sepsis and sterile inflammation reveals a robust diagnostic gene set." Science Translational Medicine (2015); 7.287: 287ra71-287ra71.

Sweeney, Timothy E., et al. "Robust classification of bacterial and viral infections via integrated host gene expression diagnostics." Science Translational Medicine (2016); 8.346: 346ra91-346ra91.

Tsalik, Ephraim L., et al. "Host gene expression classifiers diagnose acute respiratory illness etiology." Science Translational Medicine (2016); 8.322: 322ra11-322ra11.

Vincent, Jean-Louis, "The Clinical Challenge of Sepsis Identification and Monitoring." PLoS Med (2016); 13: e1002022-10, 10 pages.

Abstract ATTS Meeting, May 2012.

Cai et al., "Novel 3D pharmacophore of α-MSH/γ-MSH hybrids leads to selective human MC1R and MC3R analogues." Journal of Medicinal Chemistry (2005), 48(6): 1839-1848.

Catania, A., "The melanocortin system in leukocyte biology." Journal of Leukocyte Biology (2007), 81(2): 383-392.

Catania, A., "The Melanocortin System in Control of Inflammation." The Scientific World Journal (2010), 14(10): 1840-1853.

Doi et al., "AP214, an analogue of alpha-melanocyte-stimulating hormone, ameliorates sepsis-induced acute kidney injury and mortality," Kidney International (2008), 73: 1266-1274; advance online publication, Mar. 19, 2008.

EP 13189492.5, Extended European Search Report dated Jan. 17, 2014, 5 pages.

EP 15157262.5, Extended European Search Report dated Aug. 19, 2015, 6 pages.

Gong, R., "The renaissance of corticotropin therapy in proteinuric nephropathies." Nature Reviews Nephrology (2011), 8(2):122-128.

Gong, R., "Leveraging melanocortin pathways to treat glomerular diseases." Advances in Chronic Kidney Disease (2014), 21(2): 134-151.

Grieco, "D-Amino acid scan of gamma-melanocyte-stimulating hormone: importance of Trp(8) on human MC3 receptor selectivity." Journal of Medicinal Chemistry (2000), 43(26): 4998-5002 (2000).

Haskell-Luevano et al., "Biological and conformational examination of stereochemical modifications using the template melanotropin peptide, Ac-Nle-c[Asp-His-Phe-Arg-Trp- Ala-Lys]-NH2, on human melanocortin receptors." J. Med. Chem. (1997), 40: 1738-1748.

Higuchi et al., "Pro-drugs as novel drug delivery systems." [TOC only] ACS Symposium Series, vol. 14; American Chemical Society, Washington, DC (1975).

Holder et al., "Melanocortin ligands: 30 years of structure-activity relationship (SAR) studies." Med Res Rev. (2004), 24(3): 325-356.

Hunt et al., "a-Melanocyte stimulating hormone and its analogue Nle4DPhe7a-MSH affect morphology, tyrosinase activity and melanogenesis in cultured human melanocytes." Journal of Cell Science (1994), 107: 205-211. Retrieved from URL:<http:/ /jcs.biologists.org/content/107/1/205. full.pdf>.

March et al., "March's advanced organic chemistry, 5th Ed." [TOC only] John Wiley & Sons (2001).

Montero-Melendez et al., "The melanocortin agonist AP214 exerts antiinflammatory and proresolvinq properties." The American Journal of Pathology (2011); 179(1): 259-269.

PCT Application No. PCT/EP2013/071935, International Search Report dated Dec. 20, 2013.

PCT Application No. PCT/EP2013/071935, Written Opinion dated Dec. 20, 2013, 6 pages.

PCT Application No. PCT/EP2013/071935, International Preliminary Report on Patentability dated Jan. 21, 2015, 11 pages.

Roche, "Bioreversible carriers in drug design." [TOC only] New York: Pergamon Press (1987).

Steinbruchel et al., "Safety, pharmacokinetics and efficacy of AP214, a novel melanocortin receptor agonist, in patients undergoing cardiac surgery on cadiopulmonary bypass." Abstract TH-P0363, American Society of Nephrology Meeting, Nov. 2011; J Am Soc Nephrol. 22: 2011, p. 196A.

U.S. Appl. No. 14/058,790, Office Action dated Apr. 9, 2015, 7 pages.

U.S. Appl. No. 14/058,790, Notice of Allowance dated Aug. 14, 2015, 8 pages.

U.S. Appl. No. 14/951,305, Notice of Allowance dated Jul. 15, 2016, 8 pages.

Wiggins, RC., "The spectrum of podocytopathies: a unifying view of glomerular diseases." Kidney International (2007), 71(12): 1205-1214.

U.S. Appl. No. 14/616,565, filed Feb. 6, 2015, Brandon et al.

Feng et al., "Clinical Significance of Soluble Hemoglobin Scavenger Receptor CD163 (sCD163) in Sepsis, a Prospective Study," PLoS One 7(7): e38400, 9 pages, 2012.

Fu, Shijun, et al. "Peripheral arterial occlusive disease: global gene expression analyses suggest a major role for immune and inflammatory responses." BMC Genomics (2008); 9.1: 369, 18 pages.

Johnson et al., "Gene Expression Profiles Differentiate Between Sterile SIRS and Early Sepsis," Annals of Surgery 245(4): 611-621 (2007).

Schlame, Michael, et al. "Study of platelet-activating factor acetylhydrolase in the perioperative period of patients undergoing cardiac surgery." Shock (1998); 9.5: 313-319.

Sivapalaratnam, Suthesh, et al. "Identification of candidate genes linking systemic inflammation to atherosclerosis; results of a human in vivo LPS infusion study." BMC Medical Genomics (2011); 4.1: 64, 8 pages.

Sutherland et al., "Development and validation of a novel molecular biomarker diagnostic test for the early detection of sepsis," Critical Care 15(3): R149, 11 pages, 2011.

Wong et al., "Toward a clinically feasible gene expression-based subclassification strategy for septic shock: proof of concept," Critical Care Medicine 38(10): 1955-1961 (2010).

Wong et al., "Identification of pediatric septic shock subclasses based on genome-wide expression profiling," Medicine 7:34, 12 pages (2009).

Casserly, Brian, et al. "Multimarker panels in sepsis." Critical Care Clinics (2011); 27.2: 391-405.

International Search Report and Written Opinion for International Application No. PCT/AU2014/050075, dated Dec. 22, 2014, 28 pages.

International Preliminary Report on Patentability for International Application No. PCT/AU2014/050075, dated Sep. 2, 2015, 14 pages.

(56) References Cited

OTHER PUBLICATIONS

Kern, Scott E. "Why your new cancer biomarker may never work: recurrent patterns and remarkable diversity in biomarker failures." Cancer Research (2012); 72.23: 6097-6101.
LaBaer, Joshua. "So, you want to look for biomarkers (introduction to the special biomarkers issue)." Journal of Proteome Research (2005); 4.4: 1053-1059.
Monforte and McPhail. "Strategy for gene expression-based biomarker discovery." BioTechniques (2005); 5: 25-29.
Peters et al., "Real-time RT-PCR: considerations for efficient and sensitive assay design." Journal of Immunological Methods (2004); 286 (1-2): 203-217.
Riedmaier and Pfaffl. "Transcriptional biomarkers—high throughput screening, quantitative verification, and bioinformatical validation methods." Methods (2013); 59.1: 3-9.
Sivapalaratnam, Suthesh, et al., "Abstract 5507: Toll Like Receptor 4 Activation Elicits Pro-atherogenic Gene Activation in Monocytes in Humans." Circulation (2008);118:S_563, 5 pages.
Cobb, et al., "Sepsis gene expression profiling: Murine splenic compared with hepatic responses determined by using complementary DNA microarrays." Critical Care Medicine (2002); 30 (12): 2711-2721.
"Concordance of Affymetric GeneChip® Human Transcriptome Array 2.0 and real-time PCR results using USB® VeriQuest® qPCR master mixes." Sponsored Paper, Application Forum, www.BioTechniques.com, vol. 25, No. 5, 2014.
Enard, et al., "Intra- and Interspecific Variation in Primate Gene Expression Patterns." Science (2002); 296 (5566): 340-343.
Morey et al., "Microarray validation: factors influencing correlation between oligonucleotide microarrays and real-time PCR." Biol. Proced. Online 2006; 8(1): 175-193, Dec. 12, 2006.
Radich et al., "Gene expression changes associated with progression and response in chronic myeloid leukemia." PNAS, Feb. 21, 2006, vol. 103, No. 8, 2794-2799.
Wurmbach, "Correlation of microarray and quantitative real-time PCR results." Mount Sinai School of Medicine, New York, 28 pages.
Wurmbach et al, "Gonadotropin-releasing Hormone Receptor-coupled Gene Network Organization." The Journal of Biological Chemistry, vol. 276, No. 50, Issue of Dec. 14, pp. 47195-47201, 2001.
Yuen et al., "Accuracy and calibration of commercial oligonucleotide and custom cDNA microarrays." 2002 Oxford University Press, Nucleic Acids Research, 2002, vol. 30, No. 10 e48, 9 pages.
U.S. Appl. No. 14/616,565, filed Feb. 6, 2015 (pending).
U.S. Appl. No. 15/201,431, filed Jul. 2, 2016 (pending).

* cited by examiner

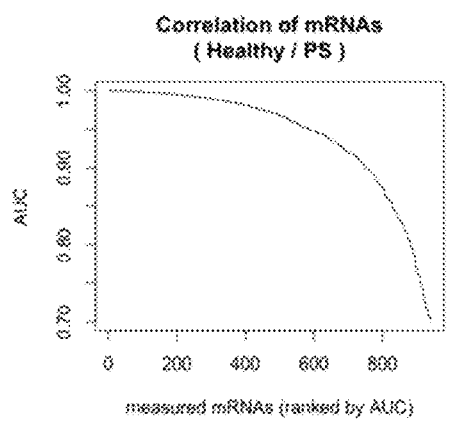
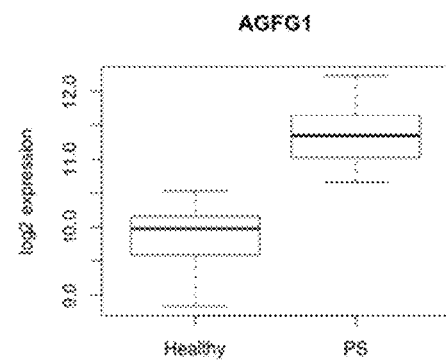
Fig. 8A  Fig. 8B
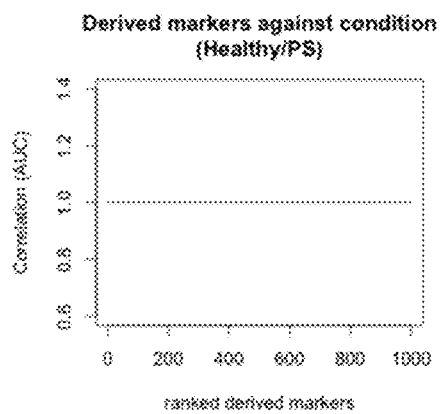
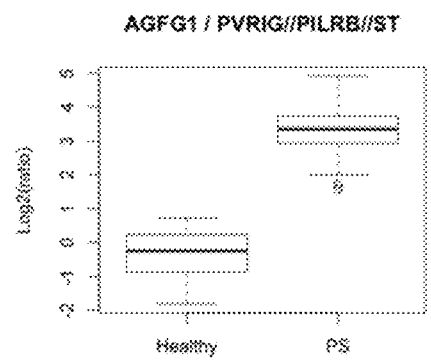
Fig. 8C  Fig. 8D
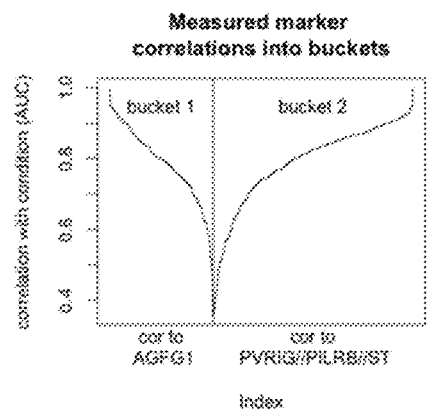
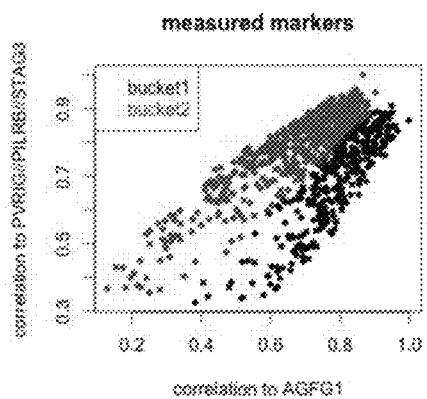
Fig. 8E  Fig. 8F

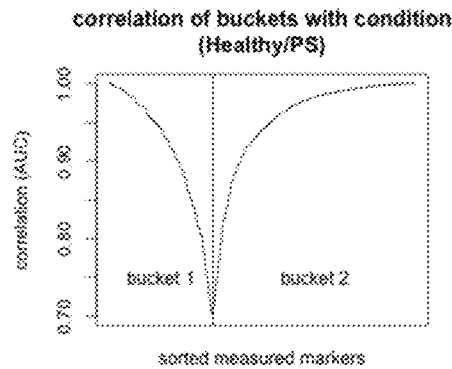
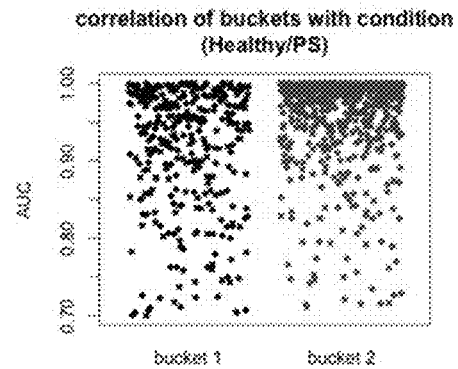
Fig. 8G
Fig. 8H
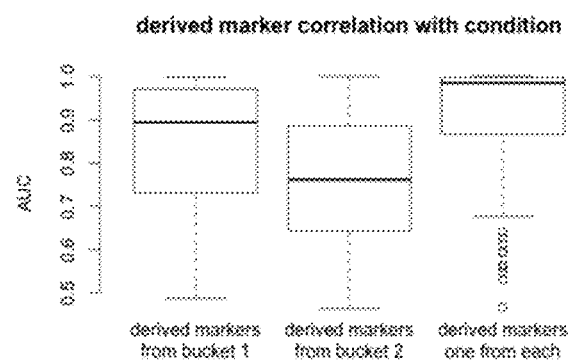
Fig. 8I

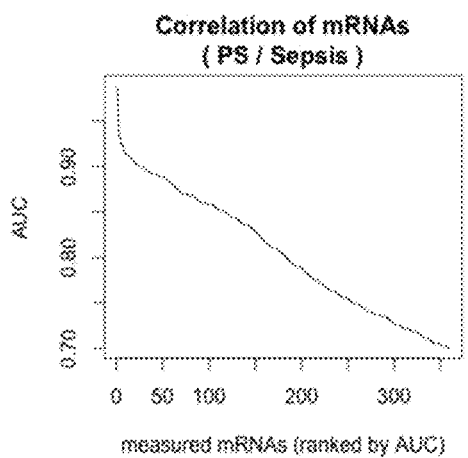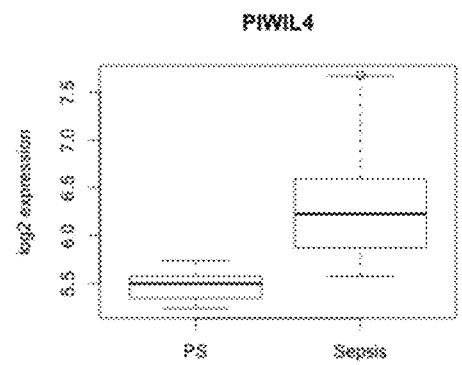
Fig. 10A   Fig. 10B
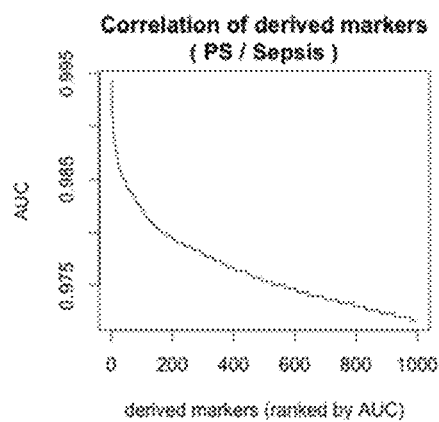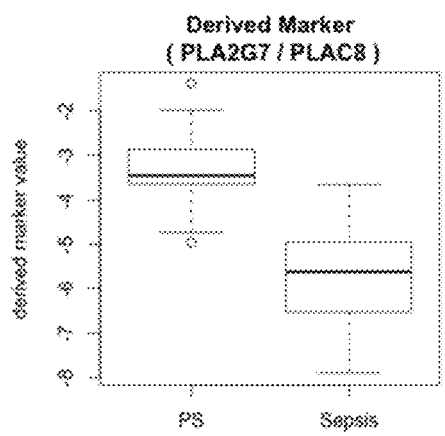
Fig. 10C   Fig. 10D
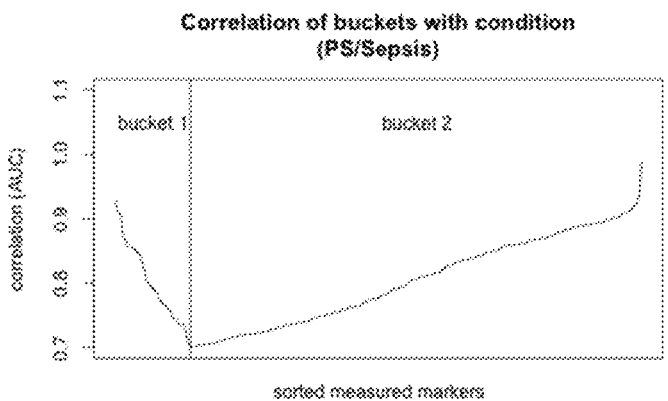
Fig. 10E

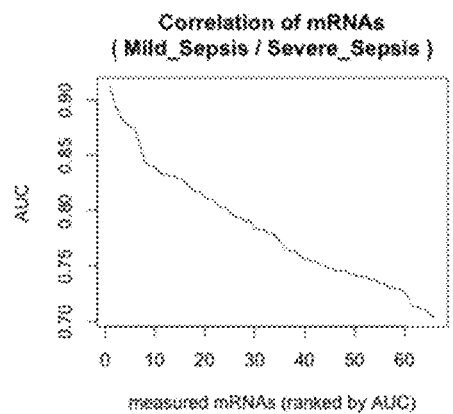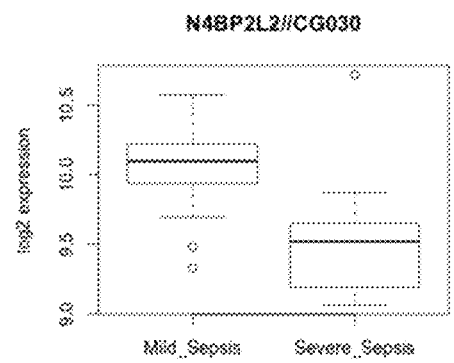
Fig. 11A        Fig. 11B
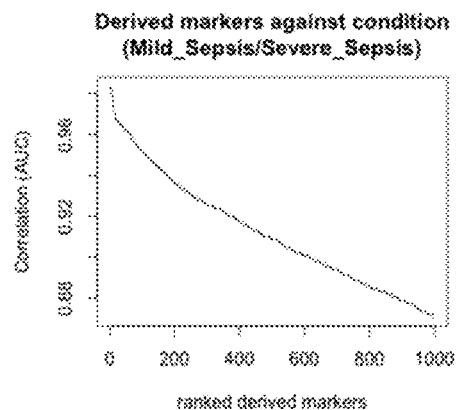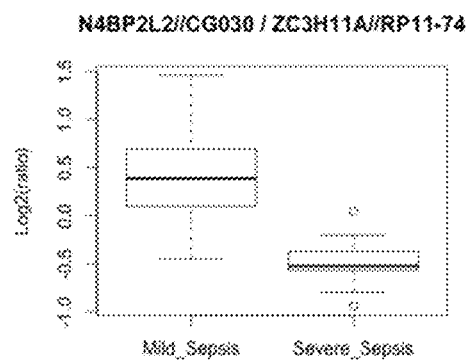
Fig. 11C        Fig. 11D
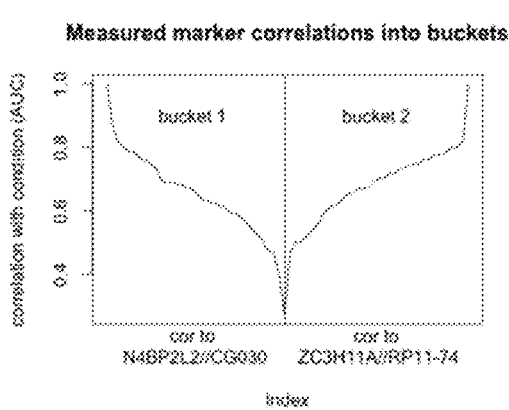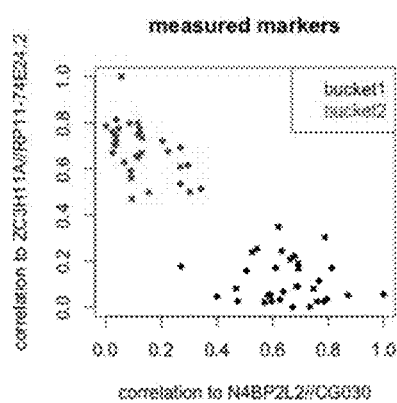
Fig. 11E        Fig. 11F Fig. 11G                    Fig. 11H

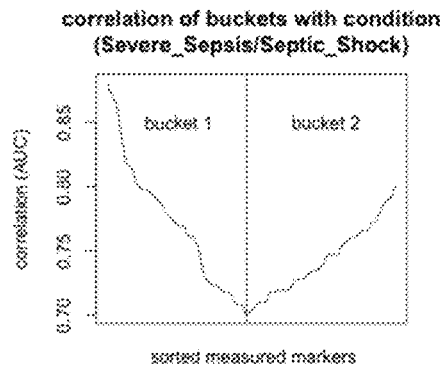 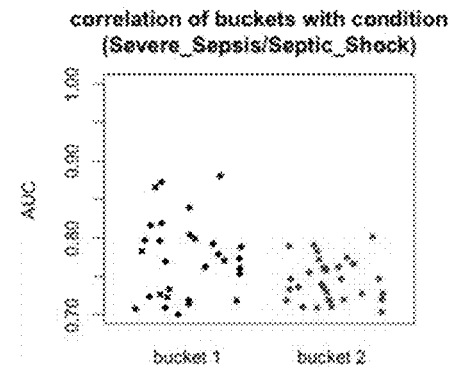
Fig. 13G Fig. 13H
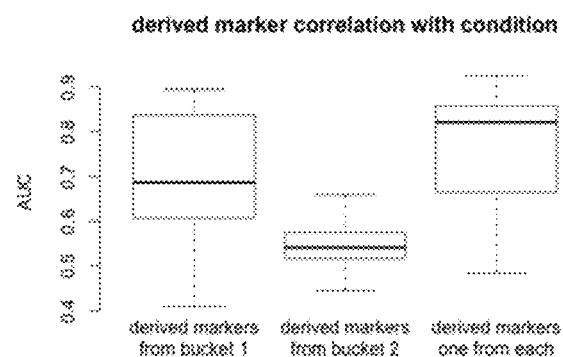
Fig. 13I

BIOMARKER SIGNATURE METHOD, AND APPARATUS AND KITS THEREFOR

This application is a divisional of U.S. application Ser. No. 14/616,565 entitled "Biomarker signature method, and apparatus and kits therefor" filed Feb. 6, 2015, which claims priority to Australian Provisional Application No. 2014900363 entitled "Biomarker signature method, and apparatus and kits therefor" filed 6 Feb. 2014, the entire contents of which are incorporated herein by reference.

STATEMENT REGARDING SEQUENCE LISTING

The Sequence Listing associated with this application is provided in text format in lieu of a paper copy, and is hereby incorporated by reference into the specification. The name of the text file containing the Sequence Listing is DAVI_035_02US_ST25.txt. The text file is 4.4 MB, was created on May 15, 2015, and is being submitted electronically via EFS-Web.

BACKGROUND OF THE INVENTION

The present invention relates to method, kit and apparatus and to reagents and compositions associated therewith for deriving an indicator for use in diagnosing the presence, absence or degree of at least one condition in a biological subject or in prognosing at least one condition in a biological subject, to a biomarker signature for use in diagnosing the presence, absence or degree of at least one condition in a biological subject or in prognosing at least one condition in a biological subject, and to a method, kit and apparatus, as well as reagents and compositions associated therewith, for identifying biomarkers for use in a biomarker signature.

DESCRIPTION OF THE PRIOR ART

The reference in this specification to any prior publication (or information derived from it), or to any matter which is known, is not, and should not be taken as an acknowledgment or admission or any form of suggestion that the prior publication (or information derived from it) or known matter forms part of the common general knowledge in the field of endeavor to which this specification relates.

The analysis of gene expression products for diagnostic purposes is known. Such analysis requires identification of one or more genes that can be used to generate a signature for use in distinguishing between different conditions. However, such identification can require the analysis of many gene expression products, which can be mathematically complex, computationally expensive and hence difficult. Much of the biomarker discovery process is devoted to identifying a subset of the data that may have relevant import, from which a signature is derived using a combination of these values to produce a model for diagnostic or prognostic use.

WO2004/044236 describes a method of determining the status of a subject. In particular, this is achieved by obtaining subject data including respective values for each of a number of parameters, the parameter values being indicative of the current biological status of the subject. The subject data are compared to predetermined data that includes values for at least some of the parameters and an indication of the condition. The status of the subject, and in particular, the presence and/or absence of the one or more conditions, can then be determined in accordance with the results of the comparison.

US2010/0028876 describes methods for diagnosing biological states or conditions based on ratios of gene expression data from cell or tissue samples, such as cancer cell or tissue samples, by differentiating between cell types, including cancer cell types. The invention provides sets of genes that are expressed differentially in normal and cancer lung cells and tissues to be able to differentiate these cells and tissues. Such cellular differentiation is important in diagnosing cancer and cancer types. The sets of genes are identified by the degree (fold change) of up or down regulation. These sets of genes can be used to discriminate between normal and malignant cells or tissues, and between classes of malignant cells or tissues. Accordingly, diagnostic assays for classification of tumors, prediction of tumor outcome, selecting and monitoring treatment regimens and monitoring tumor progression/regression also are provided.

However, traditional methods for biomarker identification and traditional combinations of biomarkers use a relatively large number of biomarkers, which in turn makes tests expensive to perform, limiting their use in practice. In addition, the prior art does not describe the use of immune system biomarker ratios, or a method of identifying minimal sets of immune system biomarker ratios useful in determining the presence, absence, degree or prognosis of immune system-mediated medical conditions.

SUMMARY OF THE PRESENT INVENTION

In one broad form the present invention seeks to provide a method for determining an indicator used in assessing a likelihood of a biological subject having a presence, absence, degree or prognosis of at least one medical condition, the method including:
  a) determining a pair of biomarker values, each biomarker value being a value measured or derived for at least one corresponding immune system biomarker of the biological subject and being at least partially indicative of a concentration of the immune system biomarker in a sample taken from the subject;
  b) determining a derived biomarker value using the pair of biomarker values, the derived biomarker value being indicative of a ratio of concentrations of the pair of immune system biomarkers; and,
  c) determining the indicator using the derived biomarker value.

Typically the method includes:
  a) determining a first derived biomarker value using a first pair of biomarker values, the first derived biomarker value being indicative of a ratio of concentrations of first and second immune system biomarkers;
  b) determining a second derived biomarker value using a second pair of biomarker values, the second derived biomarker value being indicative of a ratio of concentrations of third and fourth immune system biomarkers; and,
  c) determining the indicator by combining the first and second derived biomarker values.

Typically the method includes combining the derived biomarker values using a combining function, the combining function being at least one of:
  a) an additive model;
  b) a linear model;
  c) a support vector machine;
  d) a neural network model;

e) a random forest model;
f) a regression model;
g) a genetic algorithm;
h) an annealing algorithm;
i) a weighted sum;
j) a nearest neighbor model; and,
k) a probabilistic model.

Typically the method is performed at least in part using an electronic processing device.

Typically the method includes, in at least one electronic processing device:
a) obtaining at least two pairs of measured biomarker values, each measured biomarker value being a measured value of a corresponding immune system biomarker of the biological subject;
b) determining a first derived biomarker value indicative of a ratio of concentrations of first and second immune system biomarkers;
c) determining a second derived biomarker value indicative of a ratio of third and fourth immune system biomarkers; and,
d) determining the indicator by combining the first and second derived biomarker values.

Typically the method includes, in at least one processing device, generating a representation of the indicator.

Typically the representation includes:
a) an alphanumeric indication of the indicator;
b) a graphical indication of a comparison of the indicator to one or more indicator references;
c) an alphanumeric indication of a likelihood of the subject having at least one medical condition.

Typically the method includes:
a) comparing the indicator to an indicator reference; and,
b) determining a likelihood in accordance with results of the comparison.

Typically the indicator reference is based on at least one of:
a) an indicator threshold range;
b) an indicator threshold; and,
c) an indicator distribution.

Typically the indicator reference is derived from indicators determined for a number of individuals in a reference population.

Typically the indicator reference is based on a distribution of indicators determined for a group of a reference population, the group consisting of individuals diagnosed as having the medical condition or lacking the medical condition.

Typically the reference population includes:
a) a plurality of individuals of different sexes;
b) a plurality of individuals of different ethnicities;
c) a plurality of healthy individuals;
d) a plurality of individuals suffering from at least one diagnosed medical condition;
e) a plurality of individuals lacking the at least one diagnosed medical condition;
f) a plurality of individuals showing clinical signs of at least one medical condition;
g) first and second groups of individuals, each group of individuals suffering from a respective diagnosed medical condition; and,
h) first and second groups of individuals, the first group of individuals suffering from a diagnosed medical condition, and the second group lacking the diagnosed medical condition.

Typically the indicator is for use in determining the likelihood that a biological subject has at least one medical condition, and wherein the reference population includes:
a) individuals presenting with clinical signs of the at least one medical condition;
b) individuals diagnosed as having the at least one medical condition;
c) individuals diagnosed as lacking the at least one medical condition; and,
d) healthy individuals.

Typically the indicator reference is retrieved from a database.

Typically the likelihood is based on a probability generated using the results of the comparison.

Typically the indicator is for determining a likelihood of the subject having a first or second condition, and wherein the method includes:
a) comparing the indicator to first and second indicator references, the first and second indicator references being indicative of first and second conditions; and,
b) determining the likelihood in accordance with the results of the comparison.

Typically the method includes:
a) determining first and second indicator probabilities using the results of the comparisons; and,
b) combining the first and second indicator probabilities to determine a condition probability indicative of the likelihood.

Typically the first and second indicator references are distributions of indicators determined for first and second groups of a reference population, the first and second group consisting of individuals diagnosed with the first or second condition respectively.

Typically the method includes:
a) obtaining a sample taken from the biological subject, the sample including polynucleotide expression products; and,
b) quantifying at least some of the polynucleotide expression products within the sample to determine the pair of biomarker values.

Typically the method includes, determining the indicator at least in part using a ratio of concentrations of the polynucleotide expression products.

Typically the method includes:
a) quantifying polynucleotide expression products by:
b) amplifying at least some polynucleotide expression products in the sample; and,
c) determining an amplification amount representing a degree of amplification required to obtain a defined level of each of a pair of polynucleotide expression products; and,
d) determining the indicator by determining a difference between the amplification amounts.

Typically the amplification amount is at least one of:
a) a cycle time;
b) a number of cycles;
c) a cycle threshold;
d) an amplification time; and,
e) relative to an amplification amount of another amplified product.

Typically the method includes determining:
a) a first derived biomarker value by determining a difference between the amplification amounts of a first pair of polynucleotide expression products;
b) a second derived biomarker value by determining a difference between the amplification amounts of a second pair of polynucleotide expression products;
c) determining the indicator by adding the first and second derived biomarker values.

Typically the immune system biomarker is a biomarker of an immune system of the biological subject that is altered, or whose level of expression is altered, as part of an inflammatory response to damage or pathogenic insult.

Typically:
a) the at least two immune system biomarkers have a mutual correlation in respect of the at least one condition that lies within a mutual correlation range, the mutual correlation range being between ±0.9; and,
b) the indicator has a performance value greater than or equal to a performance threshold representing the ability of the indicator to diagnose the presence, absence, degree or prognosis of the at least one condition, the performance threshold being indicative of an explained variance of at least 0.3.

Typically the mutual correlation range is at least one of:
a) ±0.8;
b) ±0.7;
c) ±0.6;
d) ±0.5;
e) ±0.4;
f) ±0.3;
g) ±0.2; and,
h) ±0.1.

Typically each immune system biomarker has a condition correlation with the presence, absence, degree or prognosis of the at least one condition that lies outside a condition correlation range, the condition correlation range being between ±0.3.

Typically the condition correlation range is at least one of:
a) ±0.9;
b) ±0.8;
c) ±0.7;
d) ±0.6;
e) ±0.5; and,
f) ±0.4.

Typically the performance threshold is indicative of an explained variance of at least one of:
a) 0.4;
b) 0.5;
c) 0.6;
d) 0.7;
e) 0.8; and,
f) 0.9.

Typically the immune system biomarker value is indicative of a level or abundance of a molecule selected from one or more of a nucleic acid molecule and a proteinaceous molecule.

In some embodiments, the indicator is for determining a likelihood of the subject having inSIRS or ipSIRS, and wherein the method includes:
a) determining a first pair of biomarker values indicative of a concentration of polynucleotide expression products of the PLA2G7 gene and PLAC8 gene;
b) determining a second pair of biomarker values indicative of a concentration of polynucleotide expression products of the CEACAM4 gene and LAMP1 gene; and,
c) determining the indicator using the first and second pairs of biomarker values.

In some embodiments, the indicator is for determining a likelihood of the subject having inSIRS or a healthy condition, and wherein biomarker values are determined from at least one inflammatory response syndrome (IRS) immune system biomarker in each of first and second IRS immune system biomarker groups, wherein:

a) the first IRS immune system biomarker group consists of polynucleotide and/or polypeptide expression products from the following IRS immune system biomarker genes: NUMB, RAB27A, USP3//LOC100130855, HIF1A, LBXCOR1//PIAS1//CALML4, SQRDL, C20orf74, IL10RB, PARP4, DNTTIP1, MTMR6//LOC646482, LAMP2, MAPK1, SERINC3//TTPAL, IGSF6//METTL9, RP2, C18orf32, LOC284757, MTMR10//MTMR15, SLC12A6, LCP1, CHP, PRR13, C20orf177, ZFP106, DICER1, PHF12, IFNAR1, BNIP2, UBE2A, NIN, MBD2//SNORA37, TM9SF2, RAB8B, CLIP1, WAS, DNAJC3, CDADC1, KIAA0317, MED13L, INTS6, PDK3, MYO5A, NUPL1, VEZF1, CUL4B, USP9X//USP9Y, RPS6KA3, IL17RA//CECR7, ELF1, TMX4, TAOK1, ELMO2, STAT5B//STAT5A, PAN3//EEF1A1//CHCHD2, SIPA1L1//SNORD56B//LOC145474//LOC283567, OSBPL1A, SYNJ1, U2AF1, NPEPPS//TBC1D3F//LOC440434, AP1G1, SNTB2, ZNF230//ZNF222, LYRM1, ME2, GALNT1, DYRK1A, ZMYM2, ARID4A, TOB1, DOCK11, ACTR10, ZMYM5//ZMYM2, FNDC3A, NUFIP2, STRADA, SPG11//ISLR, SPATA13//C1QTNF9, BRWD3, BACH1, CLTC, LIG4, C21orf41//BACH1, KPNB1, DHRS7, USP8, LACTB, SYNE2, ZDHHC20//LOC728099, EAPP, MED13//LOC100129112, TAOK3, NLGN3, CIT, RIPK3, CP110, ABHD2, GNA13, GGNBP2, PXN and PTPN1 (hereafter referred to interchangeably herein as "group A IRS immune system biomarker genes" or "group A IRS biomarker genes"); and b) the second IRS immune system biomarker group consists of polynucleotide and/or polypeptide expression products from the following IRS immune system biomarker genes: AGFG1, BMX//HNRPDL, MCM5, TRIM28, GRWD1, ZNF574, ARRDC2, PELP1, SHPK, GPS1, FAM38A, FBXO31, C16orf58//LOC100128371, NLRC3, JMJD8, CDK10, TRAPPC2L, PRMT7, BRF1, MTA1/LOC647310//LOC100128343, PLD4, DDX54//CCDC42B, PLBD1, IRAK3, FGD4, ARG1, RANGAP1, UNC84B, SAMSN1//LOC388813, PFKL, S100A12, KIF22, LRRN1, CCDC134, LZTR1, GZMM, ICAM2, TMC8, LAT//SPNS1//NPIPL2//LOC728741//LOC730153//NPIPL3//SPIN1//LOC728888//LOC100289169//LOC728734//LOC729602//LOC100288442//LOC100288332, CLEC4D, CDK5RAP1, PPP1R16B, DAZAP1, LMF1, EDC4, IL21R//LOC283888, JMJD7-PLA2G4B//JMJD7//PLA2G4B, TMEM120B//RHOF, ENTPDH/C10orf131, ACSL1, ZC3H7B, CHERP//C19orf44//CALR3, U2AF2, PYGL, SOS2, ANKRD22, MEGF9, MGAM//LOC100124692, IL1R2, IL2RB, FCAR, IL27RA, DHX37, PATZ1, PRDM15, NOSIP, RPTOR, SPG7, DNAJA3, VNN1, SEPT9, THAP11, LPCAT2, MAN2C1, PITPNM2, NOC2L//SAMD11//LOC401010, ZMYM3, FTSJ1, KCNE1, ACTR5, FAM110A, FAM134C, LLGL2, INF2, KDM2B, ACSL4, B4GALT5, CD79B, BCL11B, ERLIN1, TLR4, EVL, SRGN, SLC37A3, GPR141, MSL3, MMP9//LOC100128028, MAP2K6, PHTF1, KLHL36, POLR3E, PCNX, PNKP, TMEM104, TRPV2, SEPT1, APH1B, POLE, MED24, MPI, C12orf49, PES1, ERCC1//CD3EAP, CD177, CPD, MEF2A//LYSMD4, C14orf43, RPLP0, CDC25B, SYMPK, ARHGEF18//LOC100128573, PSTPIP2, HERC2//HERC2P2//HERC2P3//LOC440248, MAPK14, F5, PLCG1, ZNF416, AARS, KLHL2, APOBEC3A//APOBEC3B, CMTM1/CKLF, USP11, MAP3K14//LOC100133991, GOLGA3, TMEM204, S100A8, IL1R1, DHPS, PPP2R1A, UBTF, DRG2, DNMT1, USP36, ZBTB4, TSC2, KIAA0915, KIAA0182, ALOX5AP, TGIF2, ST20//C15orf37, FN3KRP, ABCD4, ZFP64, NEO1, PPIL2//YPEL1, RNPS1, NF2, SERPINB1, DDX51, PRPF6, TIMM22, SYS1//SYS1-DBNDD2//DBNDD2, RAB31, KRI1, SMARCA4, CLUAP1, C16orf67, C20orf4, CHTF8//HAS3, NPTN, CSRP2BP, AES, ODZ1, MTMR15//MTMR10, SIRPD, EEF2//SNORD37, DKC1/SNORA36A//SNORA56, CEACAM4, C12orf43, RANBP3, EEF2K, LOC338799, PLP2, AKAP8, ELAC2, AKAP1, TBC1D4, ALOX5, WSB1, BAZ1A, ETS2, GGA2, CSTF2//RAD21, METTL9, GYG1, CRAMP1L//HN1L, EVI2B, PPP1R13B, POP5, C20orf3, WDR59, KCNJ15, PGLYRP1, ELAVL1, SLC25A1, PSMD3, CDC42EP3, FTSJ3, C2CD2, RBM19, CDH26, TRMT2B, GTF2F1//LOC100130856, SNRPN//SNURF//IPW//SNORD116-16//SNORD116-18//SNORD116-21//SNORD116-22//SNORD116-17//SNORD116-19//PAR5//PAR-SN//SNORD116-2//SNORD116-25//SNORD116-26//SNORD107//SNORD116-12//SNORD115-5//SNORD115-6//SNORD115-9//SNORD116-11//SNORD116-12//SNORD116-13//SNORD116-28//SNORD116-4//SNORD64//PAR1//SNORD109A//SNORD109B//SNORD116-6//SNORD116-3//SNORD116-9//SNORD115-13//SNORD115-1//SNORD115-14//SNORD115-15//SNORD115-21//SNORD115-10//SNORD115-7//SNORD115-16//SNORD115-40//SNORD115-42//SNORD115-11//SNORD115-29//SNORD115-34//SNORD115-36//SNORD115-4//SNORD115-43//HBII-52-24//SNORD116-5//SNORD116-7//SNORD115-26//SNORD115-30//SNORD116-15//SNORD116-8//SNORD115-2//SNORD115-39//SNORD116-14//SNORD116-20//SNORD115-8//SNORD115-3//SNORD115-38//SNORD115-41//SNORD115-22//SNORD115-44//SNORD116-1//SNORD115-17//SNORD115-18//SNORD115-19//SNORD115-20//SNORD116@, SLC9A8, RPA1, ADARB1, AFG3L2, MCTP2, DACH1, SEH1L, RRP1B, ZNF335, WDR73, TAF15, MOSPD2, WIPI-MARSG, ARRB2, PLIN5ARG1, SNRPD3//C22orf13, CTNNBL1, ZNF175, NCF4, DDX27, FBXO21, TDP1, ATXN2L, ILF3, VAPA, DDX19B//DDX19A, NCOR2, KL, MTHFS, TOM1L2//LOC246315, APOBEC3D, EXD2, CDR2//RRN3//LOC100131998//LOC653390, ADCY4, DHX33, CKLF, GTF3C1, PRKCSH, DHX35, HSPH1, CCDC92, BCOR, CCPG1//PIGB//DYX1C1, MCM3AP, FPR1, ZNF460, AKAP8L, DCAF7, RNF24, NSMCE1, PDHA1, SAFB2//SAFB, ITM2B, ZNF236, PI4KA//PI4KAP1//PI4KAP2//LOC100293141, CSTB, C14orf138, ITGAL, ARID3A, COG7, TYROBP, HP//HPR, SRCAP//SNORA30, COG1, GK//GK3P//FTL//LOC652904, C15orf63//SERF2, SERPINA6, SMG6//C17orf6, INO80, C16orf62, RAB35, PEF1, C14orf101, TMEM185A, LIMK2, CTCF, DIABLO//B3GNT4, VPS33A, UNQ1887, TBCB//POLR2I, ABHD13, SLC24A6, EDNRB, CA12, ANAPC5, TMC3, TRIAP1, ABHD12B, TDRD9, EIF2B1, CXorf59, LRRC37A3//LRRC37A2//LRRC37A//ARL17P1//LRRC37A4//LOC100294335//LOC644397, SDS, SYCP2, TBC1D8B, TMEM31, GUCY1B2, PFN1, SLC24A3, ABCC11//LONP2 and ZNF257//ZNF492//ZNF99//ZNF98//LOC646864 (hereafter referred to interchangeably herein as "group B IRS immune system biomarker genes" or "group B IRS biomarker genes").

In some embodiments, the indicator is for determining a likelihood of the subject having ipSIRS or a healthy condition, and wherein biomarker values are determined from at least one IRS immune system biomarker in each of first and second IRS immune system biomarker groups, wherein:

a) the first IRS immune system biomarker group consists of polynucleotide and/or polypeptide expression products from the following IRS immune system biomarker genes: LTBP3, LPHN1, NR1D1//THRA, METTL9, PLD4, MAPK14, FAM102A, MYBBP1A//SPNS2, FLJ10232, SEMA4C, LMF1, PLBD1, MAN1C1, B4GALT5, ENGASE, NDRG2, TLR5, WDR4, PATZ1, CD177, LILRA5, SIRPD, ADAMTS10, TCF7, GGT7, GYG1, CDAN1, BRF1, GPR84, TMC6//LOC100131096, PGAP3, GRAP//SNORD3B-1//SNORD3B-2//LOC400581, SHPK, NOG, PVRIG//PILRB//STAG3, TDRD9, TMC8, C14orf21, NLRC4, APBA2, TBL3, LDOC1L, C16orf58//LOC100128371, KLHL3, IRAK3, JMJD7-PLA2G4B//JMJD7//PLA2G4B, RAB31, IL1 ORB, NFATC1//LOC100127994, S100A12, SLC2A3//SLC2A14, GPA33, PLXDC1, BCL6//LOC100131635, GTPBP3, SQRDL, CD7, TMEM177//LOC100125918, FBXO31, CACNA1E, LILRA4, FAM38A, UBE2J1, SBF1//SBF1P1, TMEM204, FCAR, CDK4/MARCH9/C3HC4, ZBTB4, PIWIL4, RNASE2//LOC643332, PRMT7, AGFG1, CMTM1/CKLF, MCTP1, ARL11, FMNL3//PRPF40B, FAM151B, BAHD1, OSBPL7, ZAP70, TUBGCP6, MAP2K6, NPTN, C3AR1, CD247, S100A8, TBCD, LMNB1/PCIF1, PFKL, GRWD1, PYGL, UPP1, OMG, SAMSN1//LOC388813, BLCAP, PTPRS, FAM20A, CARD6, SPPL2B, IL2RB, SORT1, BST1, TAF1C//ADAD2, SEMA4F, NCAPH2, MCTP2, ZAK, CCR7, MAN2C1, NEURL4//GPS2//D4S234E, BMX//HNRPDL, TRAPPC6A, LPCAT2, C19orf60, SLC4A10, C14orf101, TP53I3, IL1RN, AIM2, UBE2R2, PNKP, ZNF70, SEPT1, NEO1, MPRIP, DPH1//OVCA2, C16orf67, CD58, RAB27A, EEF2K, CLIC1, MBLAC2, IFNGR2, CRTC1//MAML2, CACNB1, GALNT3, C19orf6, C20orf74, RALB, GPRASP1, CA4, ETS2, RP2, MARS2, RAB32, FAIM3, C20orf24//SLA2, ZNF549, PIGL, PHTF1, IL18R1, IPO4, ZFP106, SLC12A4, DNTTIP1, S100A11, ZNF544, ATXN1, GNLY, MID2, BACH2, INF2, ARFGAP1, MSL3, SOS2, ARL8A, PTPRJ//OR4B1, NAT9, RHOT2//FBXL16, PNPLA1, DNAJC13, GNG5, FAM129C, PXK, C10orf119, BATF, LMO7, KLF2, NRD1, CLCN7, GLA, CFLAR, SYCP2, IMAGE5303689, LPGAT1, PTGDR, LAMP2, ZNF607, INSL3//JAK3, DUSP3, PCNX, CD79B, IRAK1, ZNF550//ZNF549, LOC100130950, SPTLC2, CTSA, RAP2C, ADCY9, MED12L, MTHFD2, CAP1, TOR1AIP2//TOR1AIP1//IFRG15, CHP, TSEN2, LYRM1, UBE2A, NUPL1, YIPF1, FRMD3, KAL1, CLTC, FLVCR2//RPS24, WSB2, KIAA0040, JAG1, GPR183, N6AMT1, ZNF563, AP3B2, SERPINB2//SERPINB10, CDH2, ITFG1, EDEM2, RNF135, HPSE, DSC1, FOXN2, RASSF2, ZNF420, ZFP28, UBE2G2//SUMO3, PTTG11P, PRKCB, KIT, PLEK, MAP4K4, GBA//GBAP, CLIP1, EDEM3, SERINC3//TTPAL, TPST2, HNRPLL, TP53BP2, KCND1, GCLM, RIT1, OSCAR, DDX59, EDNRB, ELMO2, RRAGC, AFTPH, DCUN1D3//LYRM1, RSBN1, IFI30, SNX1, PTPN1, SEP15, ARMCX5, ALAS1, NFKBIA, STXBP2//L00554363//LOC100131801, C15orf24, SRI, ASGR2, NSF//LOC728806, TRIM69, SEC23A, PLAUR, RAB3GAP2//AURKAPS1//AURKA//SNORA36B, MAOB//NAT13, DEDD, SEC23B, COPA, EGF, STRADA, SIAE, C5, SLC30A1, ANXA4, NKG7, ABHD12B, TESK2, LONRF3, PIKFYVE, SH3BGRL3, ARMCX3, NEU1, SPAST, STX6//KIAA1614, TADA3L, LIN37// PSENEN, UBR3, WDR90, RTN2 and TMUB2 (hereafter referred interchangeably herein as "group C IRS immune system biomarker genes" or "group C IRS biomarker genes"); and, b) the second IRS immune system biomarker group consists of polynucleotide and/or polypeptide expression products from the following IRS immune system biomarker genes: CNNM3, SLC25A45, UNC84B, ARHGEF18//LOC100128573, PIK3IP1, EPHX2, SEPT9, ITPKB, TSPYL2//GPR173, GALT, USP11, CBX7//LOC100128400, MAP3K14//LOC100133991, CDK5RAP1, KLHL36, SPG7, ZNF574, RASA3, KLHL22//KRT18, PYGO2, USP36, LCK, SKI, C5orf45//SQSTM1, PIK3C2B//LOC100130573, ANGEL1, ZCCHC14, CIRBP, ZMIZ2, TMEM120B// RHOF, NOC2L//SAMD11//LOC401010, PPP1R13B, ZNF416, PBXIP1, SMYD5//NOTO, ZNF529, EDC4, LENG8, TBC1D22A//LOC100289878, CORO7, COG8//PDF, CUL9, RASGRF2, CHERP//C19orf44// CALR3, POLR3E, CNNM4, TSC2, XYLT2// LOC100130580, TP53, LMBR1L, AKT1, SLC7A6// SLC7A6OS, LDLRAP1, SGSM2, ZNF764//ZNF747, AKAP1, RNPS1, ICAM2, KIF3A, TGIF2, VAC14// LOC100130894, CXXC5, DCAF15, TARBP1, RCAN3, IMP4, LUC7L, SIN3B, TRMT2B, POFUT2, AXIN1, PPIL2//YPEL1, NLRP1//LOC728392, TMEM63A, TMEM208, ZNF362, GNG7, CASS4, ZNF287, DGKE, CEP68, ASXL1, CLUAP1, WDR89, CD40LG, MGC57346//C17orf69, PPIE//CCDC25, FCHO1, TNPO2//SNORD41, CSNK1E//LOC400927, CLYBL, XAB2, METT10D//LOC284009, PRPF6, AKAP8, SH3BP1//PDXP, TOM1L2//LOC246315, ZNF329, ZNF274, FAM119A, SMYD3, UNC84A// C7orf20, ZNF256, PSD4, CCDC130, LIMD2// MAP3K3, ELP2, ZNF8, AFG3L2, TXK, DDX27, FBXL12, TNRC6C, TADA1L, KIAA0355//FLJ21369, ZNF211, ZNF808//ZNF578//ZNF611, SRCAP// SNORA30, BANP//RUNDC2C, ADARB1, CCDC71, KTI12, TCF25, XYLT1/LYRM2//ZC3H11A, DET1, ABCF3, PRKCZ, KIAA0141, CHI3L1, RPGRIP1, TTC31, MTMR15//MTMR10, MEF2D, TMEM50B, GLOD4, PRPF8, C14orf43, P2RX5, MSH2, PCCA, DENND4B, SLC43A2, MAPK8IP3, TUBGCP5, C19orf2, SEH1L, CCDC104, TRIM62, TDRKH, COG1, POLR1B, AFG3L1, TYK2, RBM3, UBTF, RP11-94I2.2//NBPF16//NBPF11//NBPF15//NBPF8// NBPF20//NBPF10//NBPF14//NBPF1// LOC100288142//NBPF12//KIAA1245// LOC100290137, ZNF41, ZNF461, PI4KA// PI4KAP1//PI4KAP2//LOC100293141, THEM4, BCL11A, CC2D1B, WDR73, BBS2//OGFOD1, RRN3//LOC653390//LOC730092//LOC100131998, NOP58, NUCKS1, ZNHIT6, RXRB, AKT3, FANCM, ERN1, FAM117B, COX11//TOM1L1, ACVR2A, RP3-402G11.5, AHCTF1, CLN8, NVL, SAPS2, DPEP3, PDE3B, DPEP2, GGA1, CCDC50, SNRPN//SNURF// IPW//SNORD116-16//SNORD116-18//SNORD116-21//SNORD116-22//SNORD116-17//SNORD116-19// PAR5//PAR-SN//SNORD116-2//SNORD116-25// SNORD116-26//SNORD107//SNORD115-12// SNORD115-5//SNORD115-6//SNORD115-9// SNORD116-11//SNORD116-12//SNORD116-13// SNORD116-28//SNORD116-4//SNORD64//PAR1// SNORD109A//SNORD109B//SNORD116-6// SNORD116-3//SNORD116-9//SNORD115-13// SNORD115-1//SNORD115-14//SNORD115-15// SNORD115-21//SNORD115-10//SNORD115-7// SNORD115-16//SNORD115-40//SNORD115-42// SNORD115-11//SNORD115-29//SNORD115-34// SNORD115-36//SNORD115-4//SNORD115-43// HBII-52-24//SNORD116-5//SNORD116-7// SNORD115-26//SNORD115-30//SNORD116-15// SNORD116-8//SNORD115-2//SNORD115-39// SNORD116-14//SNORD116-20//SNORD115-8// SNORD115-3//SNORD115-38//SNORD115-41// SNORD115-22//SNORD115-44//SNORD116-1// SNORD115-17//SNORD115-18//SNORD115-19// SNORD115-20//SNORD116@, C17orf65//ASB16, ZNF317, SNRNP200, CXorf26, MTBP, NOL11// SNORA38B, CCNL2, ALDOC, PITPNC1, FASTKD2, ZZZ3, PIK3R5, WDR82, GLDN, CHML, C15orf40, DIDO1, CLCC1//GPSM2//C1 orf62, SLC35D1, SCRN1, C15orf63//SERF2, ZNF460, SAFB2//SAFB, C16orf54, DDX18, CTPS2, ZNF382, ZNF101, LIPT1//MRPL30, ITGA6, KIF21B, INPP5B, SF3A1// CCDC157, ODF2L, NUAK2, CHCHD5, AHSA2// USP34, YLPM1, TERF2, ZNF830, MAN2B1// MORG1, GPATCH8, SHC1, SEPT4, SFRS2, TMC3, OTUD5, NARG1L, MKL1//KIAA1659, YTHDF1, SLC14A2, GGA3 and EXOC7 (hereafter referred to interchangeably herein as "group D IRS immune system biomarker genes" or "group D IRS biomarker genes").

In some embodiments, the indicator is for determining a likelihood of the subject having inSIRS or ipSIRS, and wherein biomarker values are determined from at least one IRS immune system biomarker in each of first and second IRS immune system biomarker groups, wherein:

a) the first IRS immune system biomarker group consists of polynucleotide and/or polypeptide expression products from the following IRS immune system biomarker genes: ALKBH5//FLJ13773, RPS19BP1, RFXANK// MEF2B//LOC729991, NA, CDC6, C19orf56, NA, ABCC2, THAP11, RTN2, MAZ, TAX1BP3, NUTF2, MPZL3, FBXW5, HIST1H2BM, CETP, PQLC1, H2AFX, KIAA0101//CSNK1G1, STK17B, SMARCD3, LOC100134934//CDK3, LPCAT4, LPP, MPZL2, ANKRD9, PRR13//PCBP2, MDS2, RBM33, GATAD2B//PLIN2, PPTC7, MYBL2, OIP5, PLA2G7, CRIPT, RNF186, CCDC125, TLE3, C3orf35, SAP130, MXD1, ZHX2, CDK5RAP3, ENTPD1//C10orf131, NDUFB7, POGZ, DOK3, MCM7, IL17F, CLPS and DUSP11 (hereafter referred to interchangeably herein as "group E IRS immune system biomarker genes" or "group E IRS biomarker genes"); and, b) the second IRS immune system biomarker group consists of polynucleotide and/or polypeptide expression products from the following IRS immune system biomarker genes: PIWIL4, C11orf82, ACRC, CLPTM1L, MAGED2, PLACE, ZDHHC4, OTX1, INSIG1, BATF, MFSD11, DNASE1L1//RPL10, C15orf24, CDS2, KEAP1, ARD1A, POLR2G, AHCY, SLC39A9, CUGBP1, FAM96B, TM7SF3, CTSZ, CD63, SPPL2A, ST3GAL2, SEC13, TM9SF1, IRAK2, GOSR2, ADIPOR2, TG, GABRR2, TPST2, DERL2, CCDC101//LOC388242, VWA5A//OR10D1P, CD300A, MRPS34, PSMA7, MAPK6, JKAMP, TLR10, RAG1AP1, NEU1, SLC30A1, PDGFC, ATOX1, CYBASC3, TMEM205//hCG_29977, FAM108B1, ACSS2, HIST1H4L, AGTRAP, RNF114, UBQLN2, EDF1, C20orf197, UBE2E1, RER1, ANKRD10, SEC22C, TM2D3, SLC15A2, TRIM28, COX15, CCDC109A, CSTF1, AIP, ACTR1A, HIST1H4I, YIF1B, TSPAN31, VPS26B, CNIH, TGFBR1, NIPA2//CYFIP1, DDAH2, BID, CYB5R1, CEACAM4, KIT, GAB2, JAG1, RPGRIP1, VAT1, GNB5//LOC100129973, SSR4//IDH3G, LAMP1, MRPL41, RUNX2, ITFG1, DNASE1, ZNRD1//NCRNA00171, NLRP1//LOC728392, STT3A, MGAT4B//SQSTM1, KIAA1257//ACAD9//LOC100132731, KLHL6, PTPN6, GALK2, DAD1//OR6J1, PDLIM5, TMEM147, TRAM1//LOC286190, LZTR1, TNPO1, ACSL5, C22orf37, PLK1, SYNE2, PSMD3, FLJ27255, PRKCD, RAB34, RPN2//EEF1A2, SLC35B1, KCNIP3, PDE3B, PXMP2//PGAM5, SDF2, HIST1H3I, LOC284757, TMEM33//DCAF4L1, CSNK2A2, LSM10, PTTG11P, ADRB3//GOT1L1, PLXNA2, DIAPH2, BICD2, HAL, RPS6KC1, TMEM106C, CD1E, SLC35A5, C7orf26, IMP3, PICALM, ARF1, FHOD1//SLC9A5, C19orf55, TOMM40L//NR1I3, INSIG2, NEK9, HCG27, SDHB, CUBN, PRDX3, CEPT1//DRAM2, ERGIC1, KPNA3, VAV1, ELMO1, CUGBP2, LASP1, COL9A2, MEGF9, ELF4, SUZ12P, SULT1A2//SULT1A1, FAM123C, FAR2, IER2, RGS2, MYBPH, MFAP3, RCHY1, MGAT1, MFSD4, CDH2, TMEM184C, CTRB2//CTRB1, MPP4, PHF12, SLBP, ADAM19, HTR1B, TRIM55, CRNN, KLHDC7A, YIPF5, SLC11A1, GABBR1, CAMKV, SLC35F5, CHRNG, CXCL14, METTLE, PHC2, GPR153, TNFRSF10D, BAT2L, GALNT2, DENND3//C8orf60, CLDN3, F11, CCDC93, FLJ46365, CYP21A2, ETV5, TRPM2, IL20, NBL1//C1orf151, NGEF, POU6F2, PTEN//PTENP1, NPC1L1, CYP4B1, NFIC, PPARGC1A, PLIN3, THPO, TIMP4, CELSR2, DMBX1, CAMK2B, PPFIA1, HCLS1, SLC6A20, C17orf66//RSL24D1, PIWIL2, DAZL//DAZ4//DAZ3//DAZ2, GAL3ST2, TPD52L1, C19orf34, RASGEF1C, BAALC//FLJ10489, NR4A2//FLJ46875, HAPLN1, CLDN18, TAS1R1, TIMD4, SKI, CCDC48, MEGF10, OSBPL6, DNAH2, ARID1B, PGC, DCST1, SDK1, CHIA, REG4//NBPF7, TMEM49//CLTC//MIR21, TMEM44, NDUFB6//DFFB, COL25A1, EPHX4, NCRNA00085, NTRK3, PKHD1, SLC2A7, NTRK1, ABHD1//PREB, SLC4A9, GPNMB, SLC5A1, SLC7A8, RTCD1, PROC, C17orf64, FLJ14100//C1orf86, NUP50, UNKL, C10orf18, TMEM61, C9orf68, CYTSA, MORN3, RAB17, CNNM3, CCDC28B, SH2D6, BARHL2, T, SNRK, TCP11, KDR, ENAM, UNKL, SPRR2C, GPR17//LOC100291428//LIMS2, C1orf175//TTC4, CACNA1D, C2orf62, LOC100132686, UNQ6126, TRIM15, GPR113//SELI, IL22, SCN10A, FAAH, MBOAT7, C7orf51, KIAA1530, TRPM8, C1orf95, DDC//LOC100129427, GABRA1, HCRTR1, DCST2, CHODL, PANS//EEF1A1//CHCHD2, LYPD6B, UGT3A1 and SERPINA6 (hereafter referred to interchangeably herein as "group F IRS immune system biomarker genes" or "group F IRS biomarker genes").

In some embodiments, the indicator is for determining a likelihood of the subject having inSIRS or ipSIRS, and wherein biomarker values are determined from at least one IRS immune system biomarker in each of first, second, third and fourth IRS immune system biomarker groups, wherein:

a) the first IRS immune system biomarker group consists of polynucleotide and/or polypeptide expression products from the following IRS immune system biomarker genes: RPS19BP1, RFXANK//MEF2B//LOC729991, C19orf56, RTN2, HIST1H2BM, CETP, PQLC1, H2AFX, KIAA0101//CSNK1G1, LOC100134934//CDK3, LPCAT4, LPP, MPZL2, ANKRD9, RBM33, MYBL2, PLA2G7, OIP5, CRIPT, RNF186, C3orf35, ZHX2, NDUFB7 and DUSP11 (hereafter referred to interchangeably herein as "group G IRS immune system biomarker genes" or "group G IRS biomarker genes");

b) the second IRS immune system biomarker group consists of polynucleotide and/or polypeptide expression products from the following IRS immune system biomarker genes: PIWIL4, C11orf82, ACRC, PLACE, ZDHHC4, OTX1, INSIG1, BATF, MFSD11, C15orf24, CDS2, POLR2G, SLC39A9, FAM96B, TM7SF3, SPPL2A, ADIPOR2, GOSR2, DERL2, TPST2, VWA5A//OR10D1P, CCDC101//LOC388242, MAPK6, PSMA7, JKAMP, TLR10, RAG1AP1, SLC30A1, PDGFC, ATOX1, TMEM205//hCG_29977, FAM108B1, UBQLN2, EDF1, C20orf197, RER1, UBE2E1, ANKRD10, SEC22C, TM2D3, SLC15A2, CCDC109A, HIST1H4I, TSPAN31, TGFBR1, CNIH, DDAH2, NIPA2//CYFIP1, BID, CYB5R1, KIT, RPGRIP1, MRPL41, RUNX2, ITFG1, ZNRD1//NCRNA00171, NLRP1//LOC728392, KIAA1257//ACAD9//LOC100132731, KLHL6, GALK2, DAD1//OR6J1, PDLIM5, TRAM1/LOC286190, TNPO1, ACSL5, SYNE2, RPN2//EEF1A2, SLC35B1, KCNIP3, TMEM33//DCAF4L1, CSNK2A2, LSM10, PLXNA2, DIAPH2, HAL, RPS6KC1, SLC35A5, PICALM, C19orf55, INSIG2, SDHB, PRDX3, CEPT1/DRAM2, KPNA3, SULT1A2//SULT1A1, FAR2, MYBPH, MFAP3, RCHY1, CDH2, TMEM184C, CTRB2//CTRB1, SLBP, CRNN, YIPF5, CHRNG, SLC35F5, METTLE, CLDN3, CCDC93, CYP21A2, NBL1//C1orf151, NGEF, POU6F2, NPC1L1, PPARGC1A, THPO, CELSR2, DMBX1, SLC6A20, C17orf66//RSL24D1, GAL3ST2, C19orf34, BAALC//FLJ10489, CLDN18, TAS1R1, CCDC48, OSBPL6, SDK1, TMEM49//CLTC//MIR21, TMEM44, NDUFB6//DFFB, NCRNA00085, NTRK3, NTRK1, SLC4A9, SLC5A1, RTCD1, FLJ14100//C1orf86, PROC, C17orf64, UNKL, C9orf68, MORN3, RAB17, CNNM3, CCDC28B, BARHL2, UNKL, LOC100132686, UNQ6126, IL22, FAAH, C7orf51, DCST2, LYPD6B and SERPINA6 (hereafter referred to interchangeably herein as "group H IRS immune system biomarker genes" or "group H IRS biomarker genes");

c) the third IRS immune system biomarker group consists of polynucleotide and/or polypeptide expression products from the following IRS immune system biomarker genes: ALKBH5//FLJ13773, RNA243, ARD1A, CDC6, AHCY, MRPS34, CYBASC3, HIST1H4L, RNF114, TRIM28, CSTF1, CEACAM4, GAB2, GNB5//LOC100129973, THAP11, SSR4//IDH3G, STT3A, NUTF2, MPZL3, TMEM147, RAB34, PDE3B, PXMP2//PGAM5, HIST1H3I, LOC284757, TMEM106C, STK17B, IMP3, HCG27, CUBN, ERGIC1, ELMO1, CUGBP2, COL9A2, MEGF9, SUZ12P, FAM123C, RGS2, PRR13//PCBP2, PHF12, ADAM19, GATAD2B//PLIN2, SLC11A1, PPTC7, PHC2, BAT2L, DENND3//C8orf60, FLJ46365, ETV5, CCDC125, PTEN//PTENP1, TLE3, NFIC, TIMP4, PPFIA1, HCLS1, SAP130, MXD1, NR4A2//FLJ46875, SKI, ARID1B, ENTPD1/C10orf131, POGZ, DOK3, REG4//NBPF7, MCM7, SLC7A8, NUP50, C10orf18, TMEM61, SH2D6, SNRK, SPRR2C, CACNA1D, TRIM15, CLPS, MBOAT7, KIAA1530, C1orf95, GABRA1, HCRTR1, CHODL and PAN3//EEF1A1//CHCHD2 (hereafter referred to interchangeably herein as "group I IRS immune system biomarker genes" or "group I IRS biomarker genes"); and, d) the fourth IRS immune system biomarker group consists of polynucleotide and/or polypeptide expression products from the following IRS immune system biomarker genes: CLPTM1L, MAGED2, DNASE1L1//RPL10, KEAP1, CUGBP1, CTSZ, CD63, ST3GAL2, SEC13, TM9SF1, IRAK2, GABRR2, TG, CD300A, NEU1, ACSS2, AGTRAP, UPF0627, COX15, ABCC2, ACTR1A, AIP, YIF1B, VPS26B, JAG1, VAT1, LAMP1, DNASE1, MAZ, TAX1BP3, MGAT4B//SQSTM1, FBXW5, PTPN6, LZTR1, PLK1, C22orf37, PSMD3, FLJ27255, PRKCD, SDF2, PTTG11P, ADRB3//GOT1L1, BICD2, CD1E, C7orf26, ARF1, FHOD1//SLC9A5, TOMM40L//NRI3, NEK9, VAV1, SMARCD3, LASP1, ELF4, IER2, MGAT1, MFSD4, MDS2, MPP4, HTR1B, TRIM55, KLHDC7A, GABBR1, CAMKV, CXCL14, GPR153, TNFRSF10D, GALNT2, F11, IL20, TRPM2, CYP4B1, PLIN3, CAMK2B, PIWIL2, DAZL//DAZ4//DAZ3//DAZ2, TPD52L1, RASGEF1C, HAPLN1, TIMD4, CDK5RAP3, MEGF10, DNAH2, PGC, DCST1, CHIA, COL25A1, EPHX4, PKHD1, SLC2A7, ABHD1//PREB, GPNMB, CYTSA, T, TCP11, ENAM, KDR, GPR17//LOC100291428//LIMS2, C1orf175//TTC4, IL17F, C2orf62, GPR113//SELI, SCN10A, TRPM8, DDC//LOC100129427 and UGT3A1 (hereafter referred to interchangeably herein as "group J IRS immune system biomarker genes" or "group J IRS biomarker genes").

In specific embodiments, the first IRS immune system biomarker is a PLA2G7 expression product, the second IRS immune system biomarker is a PLAC8 expression product, the third IRS immune system biomarker is a CEACAM4 expression product and the fourth IRS immune system biomarker is a LAMP1 expression product.

In some embodiments, the indicator is for determining a likelihood of the subject having mild sepsis or severe sepsis, and wherein biomarker values are determined from at least one IRS immune system biomarker in each of first and second IRS immune system biomarker groups, wherein:

a) the first IRS immune system biomarker group consists of polynucleotide and/or polypeptide expression products from the following IRS immune system biomarker genes: N4BP2L2//CG030, FAM96A, MINPP1, MORC3//DOPEY2, LSM8, PLEKHA3, MITD1, ATF4, B2M, TMX3, ZNF273, PLEKHF2, UNQ2999, DPM1, OCLM, NADK, GPR65, SFRS3, ZNF28, PFDN4, COQ10B, SLC30A6//DDX50, KPNA5, ATP6V1G1, HAUS2, hCG_2039148, RAB33B, BET1, UBE2V2, ATP6AP2, SUBH/TMEM183A, TMEM188, ABHD3, LAPTM4A, RNF138, CCDC82, TMEM179B, PAPD4, VAMP2, CCDC126, ATG3, CHCHD5, RBM39//LOC643167, NAT8B, HAT1, CNOT6L, ZBED5, GOLT1B, TTC33, ACTN1, ACTR6, GNB4, TMEM208, CCNH, C4orf34, HAUS6//SCARNA8, TCTN1, SF3B14, TMEM138, TTC35, DLEU2//DLEU2L, MFSD8, COX7A2L, UGGT2, CEPT1/DRAM2, LEMD3, CREBZF, RPL21P44, ANGEL2, UFM1, XPO1, CALM2//C2orf61, PLDN, CLK1//PPIL3, C1orf84, PPA2, FPGT//TNNI3K, ORC4L, SLC25A14, H3F3B//H3F3C, FAM188A, MCM9, KLHL9, NACA, PAFAH1B2, CRLS1, TSSK4, LOC152217, ZNF568, ATP6V0D1//LOC100132855, CDC37L1, FNTA, SHFM1, JKAMP, TMEM126B, MRPL47, DENND1B, ATP6V0E1//SNORA74B, LIN7C, HAUS3//POLN, SLC30A7, VAMP3, OBFC2A, MAGT1, STARD3NL, C5orf15, PSMD10, RERE, RNF139, SFT2D2, SKP1, RNPC3//AMY2B, MYOM1, TIPRL, HPRT1, TRIM21, VRK2, CDKN1B, ANKRA2, RAP2B, FAM127B//FAM127C//FAM127A, FAM126A, TMEM161B, UNQ1887, FANCF, SELT, CYP20A1, RWDD1, ARPP19, SC5DL, TICAM2//TMED7//TMED7-TICAM2, STAM, LEPROTL1, RNF44, DCP1B, TNNT3, UCHL5, UPRT, SON, PIK3C3, SFRS1//FLJ44342, FBXO22//FBXO22OS, SCFD1, C11orf31, TMTC3, CCDC132, TMBIM4//LOC100133322, ATAD1, APH1A, MYNN, HADHB, PIGN, RNA243, SLC38A9, C10orf84, CDKN1A, ATP7A, RPAP2, ZNF451, GSK3B//LOC100129275, TMSB10, KCTD5//PRO0461//PDPK1, VPS29, WIPF3//ZNRF2//LOC441208, SFRS5 and C11orf73 (hereafter referred to interchangeably herein as "group K IRS immune system biomarker genes" or "group K IRS biomarker genes"); and, b) the second IRS immune system biomarker group consists of polynucleotide and/or polypeptide expression products from the following IRS immune system biomarker genes: C13orf1, PRKCB, APOBEC3A//APOBEC3B, SFRS9, NCAPD2//SCARNA10//FADS1, GATS, LOC284757, TSHZ2, JAK1, MAPK13, RPN1, GNAS, CYTSA, TRPM6, C22orf30, PCMTD1//PXDNL, CCDC69, ARSD, MLL3//BAGE2, NCOR1/C20orf191//LOC100131704, MRPS7, VEZF1, GSR, POU2F1, VPS4A, SMG7, PTP4A2, OSBP, GLCCI1/tcag7.903, DOCK2, PCNX, GLTP, FBXO18, YY2, TCF20, NR2C2//MRPS25, TEX2, BAMBI, WHSC1L1, UBTF, FAH, GEMIN4, DDEF11T1, FAM50A, VPS13D, SATB1//TBC1D5, PARP6, SETD5, PHF21A, IRF4, ZNF217, UBE4A, HIVEP1, HDLBP, GNAI2, MED13L, FOXP1, NSD1, DDOST, TMBIM6, ABLIM1, SYNRG//LOC100131822, KDM3B, ASH1L, NCOA2, GPRIN3, NCOA1, KLF3, LOC100288114//MGC9913, VPS26B, AHCYL1, CDC6, PLCG2, IL16, GIT2, TACC3, MAP4K4, NEK9, FAM149B1//FAM149B2, VPS8, ATXN7, WDFY4, ZC3H11A//RP11-74E24.2, THRAP3, ZNF346, AP3M2, CD14, CLASP1, ABCC2, ATXN7L1//RINT1//EFCAB10, INO80D, CTPS, LRRC37A3//LRRC37A2//LRRC37A//ARL17P1//LRRC37A4//LOC100294335//LO C644397, DNASE1, LRRN3, ZNF318, PRKAR2A, MRPS15, ANKHD1-EIF4EBP3//ANKHD1/EIF4EBP3, BTF3L4, DGKA, C10orf119, MBD5, C11orf30, CDC2L5, DPP4, DCTN4, TP53BP2, IMPDH2, GOT2, ELMO1 and PARP1 (hereafter referred to interchangeably herein as "group L IRS immune system biomarker genes" or "group L IRS biomarker genes").

In some embodiments, the indicator is for determining a likelihood of the subject having mild sepsis or septic shock, and wherein biomarker values are determined from at least one IRS immune system biomarker in each of first and second IRS immune system biomarker groups, wherein:

a) the first IRS immune system biomarker group consists of polynucleotide and/or polypeptide expression products from the following IRS immune system biomarker genes: EEF1DP3, GIMAP7, ZNF839, PYGL, TNFAIP8L2, SFRS9, VIM, GLTP, WDFY4, APPL2, C4orf3, PLD1, LIN7A, ELP2, ZDHHC3, UBAP1/K1F24, C20orf177, FAM149B1//FAM149B2, E2F3, SPATA1, DACH1, FAM47E//STBD1, SVIL//hCG_1783494, METTL9, LRRC42, NUPL1, UPP1, AFF2, SLC16A4, SET, CA4, HCK, C16orf72, EXT1, NOP58, FRZB, C9orf6//IKBKAP, VASP, ASB8//PHB, GTDC1, SLC39A9, FBXO34//KIAA0831, RABGEF1//tcag7.967//tcag7.951//KCTD7//LOC100293333, SLC28A3, WIP11//ARSG, NFE2, GOLGA1/SCAI, C9orf84, RPS6KA2, PSMA7, C19orf59, ICA1, TOR1AIP2//TOR1AIP1//IFRG15, MSRA, FPR1, TP53I3, FOXL2, CD63, PIGC, CENPBD1, CYB5R1, GNB2, ZNF197, KLF7, NSFL1C, USF2, PARP6, MAP9, TSPO, CSTB, DDA1, SLC36A4, GFOD2, OCRL, ZNF232, APH1B, TALDO1/INTS8, DENND2C//BCAS2, RAB11FIP2, LARS, PLP2, EIF4E2, DNASE1L1//RPL10, AFTPH, TMCO3, RPA2, UQCRC1, ZDHHC3, and ACTR1A (hereafter referred to interchangeably herein as "group M IRS immune system biomarker genes" or "group M IRS biomarker genes"); and, b) the second IRS immune system biomarker group consists of polynucleotide and/or polypeptide expression products from the following IRS immune system biomarker genes: CD6, ITPA, PVRIG//PILRB//STAG3, FLT3LG, IL12RB1, MAP3K14//LOC100133991, FAM102A, TMC8, TMEM208, TMEM109, C1orf84, NADK, SEPT1, UBA7, CD5, C12orf62, C20orf112, FOXP4, EIF4A2//SNORA4, ZNF487//LOC439911, KCTD13, IL18BP//NUMA1, KPNA5, EDC4, ZNF587//ZNF417, NBR2, RPL28, ZNF738, SHFM1, CNO, C9orf82, RPL5//SNORA66//SNORD21//FAM69A, VAMP2, SIT1, SFRS3, LCK, IRF9, MRPS21, NEFM//LOC100129717, RCN2, BET1, C19orf6, SH2D1A, GLS, OR1C1, RBM14//RBM4, CCDC97, TUT1, MRPL14, ENOPH1, NAGK, DPM1, MPV17, SH2D3C, TMEM204, C3orf42, ARSD, FAM96A, LSM8, ATP5G1, KTI12, ARL4C, C11orf31, C16orf58//LOC100128371, CCDC109B//HIGD1A//CCDC13, NUDT21, ZFP106, ACTR6, LIX1L, MEF2D, ZNF407, TMEM18, NAT11, DNAJC24, PLEKHA3, GPN2, SMCR7, C7orf23//DMTF1, PPM1G, CNOT6L, NACA, FNTA, GRIA2, N4BP2L2//CG030, ENOSF1/TYMS, THBS4, LUC7L2, MOCS2, ZNF383, AKNA, UBE2Z, FLJ34077, SH3KBP1, POLR2F//LOC100131530, ILIA, UBE2V2, KIAA1919, PRKCB, SHOC2, RBM46, GRPEL2, KCNG3, PCDH10, XAB2, VPS52, MCCC2, NSMCE4A, PTP4A2, SNX2, COQ10A, C6orf182, RNF44, MOGS, DIRAS3, Mitochondrial, KIAA1826, SGK196, NSUN5//NSUN5B//NSUN5C, Mitochondrial, MORF4L2, MAK16//C8orf41, PILRB//PVRIG//STAG3, SAAL1, TMX3, PTPRG, MAPK1, DNAJA3, LEAP2, LMOD3, ASB6, MTMR10//MTMR15, HIBADH, MORC1, CORO1A//LOC606724, SFXN2, HSN2, AAAS, INHBA, MRPS7, LRRFIP1, KCTD7//RABGEF1, DCDC2//KAAG1, SLCO3A1, DENND4B, CFTR, MOG, QRFPR, BAT2//SNORA38, ITPR3, C3orf22, TNFRSF4, ZNF646//ZNF668, GCM2, CDK4//TSPAN31, FXC1, RNMT, CHST4, POLR3E, PDE8B, C6orf146, CHCHD5, TARBP1, TADA1L, PREX2, TRAP1//DNASE1, ZNHIT6, RGP1//GBA2, SMCP, ZC3H15, TRAPPC4, SARNP//DNAJC14, GNAS, C14orf104, IL20RA, WAC, SLIT3, C4orf39, TSEN54, PPP1R13B, TRIM35, HGC6.3, YIPF3, HQ0644/PRO0644, FAM13C//PHYHIPL, BCCIP//DHX32, ACADM, SUB1//TMEM183A, KPNA1, SPAG17//WDR3, KIAA1549, DIABLO//B3GNT4, ZBTB44, EIF1AD, RUNX1T1, TRIL, PTPLB, DHDDS, UPK1A, OTUB1, C1orf182, HAPLN2, SOBP, RYR3, LRRC17, TKTL2, TMBIM6, and GDNF (hereafter referred to interchangeably herein as "group N IRS immune system biomarker genes" or "group N IRS biomarker genes").

In some embodiments, the indicator is for determining a likelihood of the subject having severe sepsis or septic shock, and wherein biomarker values are determined from at least one IRS immune system biomarker in each of first and second IRS immune system biomarker groups, wherein:

a) the first IRS immune system biomarker group consists of polynucleotide and/or polypeptide expression products from the following IRS immune system biomarker genes: SIRPG//SIRPA, GATA3, FAM102A, UPF3A, ATP13A5, CACNA1I and RANBP17//USP12 (hereafter referred to interchangeably herein as "group O IRS immune system biomarker genes" or "group O IRS biomarker genes"); and, b) the second IRS immune system biomarker group consists of polynucleotide and/or polypeptide expression products from the following IRS immune system biomarker genes: GABRA6, HAPLN1, YSK4, FOXL2, TLL1, MECOM, COL3A1, HRG, SLC22A3, C8orf45, SCN7A and SNTG1 (hereafter referred to interchangeably herein as "group P IRS immune system biomarker genes" or "group P IRS biomarker genes").

In another broad form the present invention seeks to provide apparatus for determining an indicator used in assessing a likelihood of a biological subject having a presence, absence, degree or prognosis of at least one medical condition, the apparatus including at least one electronic processing device that:

a) determines a pair of biomarker values, each biomarker value being a value measured or derived for at least one corresponding immune system biomarker of the biological subject and being at least partially indicative of a concentration of the immune system biomarker in a sample taken from the subject;

b) determines a derived biomarker value using the pair of biomarker values, the derived biomarker value being indicative of a ratio of concentrations of the pair of immune system biomarkers; and, c) determines the indicator using the derived biomarker value.

In another broad form the present invention seeks to provide a composition comprising at least one pair of reverse transcribed mRNAs and at least one oligonucleotide primer or probe that hybridizes to an individual one of the reverse transcribed mRNAs, the at least one pair of reverse transcribed mRNAs comprising a first pair and a second pair of reverse transcribed mRNAs, wherein the first pair comprises a PLAC8 reverse transcribed mRNA and a PLA2G7 reverse transcribed mRNA and wherein the second pair comprises a CEACAM4 reverse transcribed mRNA and a LAMP1 reverse transcribed mRNA.

In another broad form the present invention seeks to provide a composition comprising at least one pair of reverse transcribed mRNAs and at least one oligonucleotide primer or probe that hybridizes to an individual one of the reverse transcribed mRNAs, the at least one pair of reverse transcribed mRNAs comprising a reverse transcribed mRNA from a first IRS immune system biomarker gene selected from group A IRS immune system biomarker genes and a reverse transcribed mRNA from a second IRS immune system biomarker gene selected from group B IRS immune system biomarker genes.

In another broad form the present invention seeks to provide a composition comprising at least one pair of reverse transcribed mRNAs and at least one oligonucleotide primer or probe that hybridizes to an individual one of the reverse transcribed mRNAs, the at least one pair of reverse transcribed mRNAs comprising a reverse transcribed mRNA from a first IRS immune system biomarker gene selected from group C IRS immune system biomarker genes and a reverse transcribed mRNA from a second IRS immune system biomarker gene selected from group D IRS immune system biomarker genes.

In another broad form the present invention seeks to provide a composition comprising at least one pair of reverse transcribed mRNAs and at least one oligonucleotide primer or probe that hybridizes to an individual one of the reverse transcribed mRNAs, the at least one pair of reverse transcribed mRNAs comprising a reverse transcribed mRNA from a first IRS immune system biomarker gene selected from group E IRS immune system biomarker genes and a reverse transcribed mRNA from a second IRS immune system biomarker gene selected from group F IRS immune system biomarker genes.

In another broad form the present invention seeks to provide a composition comprising at least two pairs of reverse transcribed mRNAs and at least one oligonucleotide primer or probe that hybridizes to an individual one of the reverse transcribed mRNAs, the at least two pairs of reverse transcribed mRNAs comprising a first pair and a second pair of reverse transcribed mRNAs, wherein the first pair comprises a reverse transcribed mRNA from a first IRS immune system biomarker gene and a reverse transcribed mRNA from a second IRS immune system biomarker gene, and wherein the second pair comprises a reverse transcribed mRNA from a third IRS immune system biomarker gene and a reverse transcribed mRNA from a fourth IRS immune system biomarker gene, wherein the first IRS immune system biomarker gene is selected from group G IRS immune system biomarker genes, wherein the second IRS immune system biomarker gene is selected from group H IRS immune system biomarker genes, wherein the third IRS immune system biomarker gene is selected from group I IRS immune system biomarker genes, and wherein the fourth IRS immune system biomarker gene is selected from group J IRS immune system biomarker genes.

In another broad form the present invention seeks to provide a composition comprising at least one pair of reverse transcribed mRNAs and at least one oligonucleotide primer or probe that hybridizes to an individual one of the reverse transcribed mRNAs, the at least one pair of reverse transcribed mRNAs comprising a reverse transcribed mRNA from a first IRS immune system biomarker gene selected from group K IRS immune system biomarker genes and a reverse transcribed mRNA from a second IRS immune system biomarker gene selected from group L IRS immune system biomarker genes.

In another broad form the present invention seeks to provide a composition comprising at least one pair of reverse transcribed mRNAs and at least one oligonucleotide primer or probe that hybridizes to an individual one of the reverse transcribed mRNAs, the at least one pair of reverse transcribed mRNAs comprising a reverse transcribed mRNA from a first IRS immune system biomarker gene selected from group M IRS immune system biomarker genes and a reverse transcribed mRNA from a second IRS immune system biomarker gene selected from group N IRS immune system biomarker genes.

In another broad form the present invention seeks to provide a composition comprising at least one pair of reverse transcribed mRNAs and at least one oligonucleotide primer or probe that hybridizes to an individual one of the reverse transcribed mRNAs, the at least one pair of reverse transcribed mRNAs comprising a reverse transcribed mRNA from a first IRS immune system biomarker gene selected from group O IRS immune system biomarker genes and a reverse transcribed mRNA from a second IRS immune system biomarker gene selected from group P IRS immune system biomarker genes.

The at least one oligonucleotide primer or probe can be hybridized to an individual one of the reverse transcribed mRNAs.

The reverse transcribed mRNAs can be derived from components of the immune system.

The reverse transcribed mRNAs can be derived from leukocytes.

The reverse transcribed mRNAs can be derived from blood cells.

The reverse transcribed mRNAs can be derived from peripheral blood cells.

The composition can further comprise a labeled reagent for detecting the reverse transcribed mRNAs.

The labeled reagent can be a labeled said at least one oligonucleotide primer or probe.

The labeled reagent can be a labeled said reverse transcribed mRNA.

The labeled reagent can be a labeled oligonucleotide linker or tag for labeling a said reverse transcribed mRNA.

In another broad form the present invention seeks to provide a kit for determining an indicator indicative of the likelihood of the presence or absence of at least one condition selected from the group consisting of inSIRS and ipSIRS, the kit comprising at least one pair of reagents comprising a first pair of reagents and a second pair of reagents, wherein the first pair of reagents comprises (i) a reagent that allows quantification of a polynucleotide expression product of the PLA2G7 gene; and (ii) a reagent that allows quantification of a polynucleotide expression product of the PLAC8 gene, wherein the second pair of reagents comprises: (iii) a reagent that allows quantification of a polynucleotide expression product of the CEACAM4 gene; and (iv) a reagent that allows quantification of a polynucleotide expression product of the LAMP1 gene.

In another broad form the present invention seeks to provide a kit for determining an indicator indicative of the likelihood of the presence or absence of at least one condition selected from the group consisting of inSIRS and a healthy condition, the kit comprising at least one pair of reagents comprising (i) a reagent that allows quantification of a polynucleotide expression product of a first IRS immune system biomarker gene; and (ii) a reagent that allows quantification of a polynucleotide expression product of a second IRS immune system biomarker gene, wherein the first IRS immune system biomarker gene is selected from group A IRS immune system biomarker genes and wherein the second IRS immune system biomarker gene is selected from group B IRS immune system biomarker genes.

In another broad form the present invention seeks to provide a kit for determining an indicator indicative of the likelihood of the presence or absence of at least one condition selected from the group consisting of ipSIRS and a healthy condition, the kit comprising at least one pair of reagents comprising (i) a reagent that allows quantification of a polynucleotide expression product of a first IRS immune system biomarker gene; and (ii) a reagent that allows quantification of a polynucleotide expression product of a second IRS immune system biomarker gene, wherein the first IRS immune system biomarker gene is selected from group C IRS immune system biomarker genes and wherein the second IRS immune system biomarker gene is selected from group D IRS immune system biomarker genes.

In another broad form the present invention seeks to provide a kit for determining an indicator indicative of the likelihood of the presence or absence of at least one condition selected from the group consisting of inSIRS and ipSIRS, the kit comprising at least one pair of reagents comprising (i) a reagent that allows quantification of a polynucleotide expression product of a first IRS immune system biomarker gene; and (ii) a reagent that allows quantification of a polynucleotide expression product of a second IRS immune system biomarker gene, wherein the first IRS immune system biomarker gene is selected from group E IRS immune system biomarker genes and wherein the second IRS immune system biomarker gene is selected from group F IRS immune system biomarker genes.

In another broad form the present invention seeks to provide a kit for determining an indicator indicative of the likelihood of the presence or absence of at least one condition selected from the group consisting of inSIRS and ipSIRS, the kit comprising at least two pairs of reagents comprising a first pair of reagents and a second pair of reagents, wherein the first pair of reagents comprises (i) a reagent that allows quantification of a polynucleotide expression product of a first IRS immune system biomarker gene; and (ii) a reagent that allows quantification of a polynucleotide expression product of a second IRS immune system biomarker gene, and wherein the second pair of reagents comprises (i) a reagent that allows quantification of a polynucleotide expression product of a third IRS immune system biomarker gene; and (ii) a reagent that allows quantification of a polynucleotide expression product of a fourth IRS immune system biomarker gene, wherein the first IRS immune system biomarker gene is selected from group G IRS immune system biomarker genes, wherein the second IRS immune system biomarker gene is selected from group H IRS immune system biomarker genes, wherein the third IRS immune system biomarker gene is selected from group I IRS immune system biomarker genes, and wherein the fourth IRS immune system biomarker gene is selected from group J IRS immune system biomarker genes.

In another broad form the present invention seeks to provide a kit for determining an indicator indicative of the likelihood of the presence or absence of at least one condition selected from the group consisting of mild sepsis and severe sepsis, the kit comprising at least one pair of reagents comprising (i) a reagent that allows quantification of a polynucleotide expression product of a first IRS immune system biomarker gene; and (ii) a reagent that allows quantification of a polynucleotide expression product of a second IRS immune system biomarker gene, wherein the first IRS immune system biomarker gene is selected from group K IRS immune system biomarker genes and wherein the second IRS immune system biomarker gene is selected from group L IRS immune system biomarker genes.

In another broad form the present invention seeks to provide a kit for determining an indicator indicative of the likelihood of the presence or absence of at least one condition selected from the group consisting of mild sepsis and septic shock, the kit comprising at least one pair of reagents comprising (i) a reagent that allows quantification of a polynucleotide expression product of a first IRS immune system biomarker gene; and (ii) a reagent that allows quantification of a polynucleotide expression product of a second IRS immune system biomarker gene, wherein the first IRS immune system biomarker gene is selected from group M IRS immune system biomarker genes and wherein the second IRS immune system biomarker gene is selected from group N IRS immune system biomarker genes.

In another broad form the present invention seeks to provide a kit for determining an indicator indicative of the likelihood of the presence or absence of at least one condition selected from the group consisting of severe sepsis and septic shock, the kit comprising at least one pair of reagents comprising (i) a reagent that allows quantification of a polynucleotide expression product of a first IRS immune system biomarker gene; and (ii) a reagent that allows quantification of a polynucleotide expression product of a second IRS immune system biomarker gene, wherein the first IRS immune system biomarker gene is selected from group O IRS immune system biomarker genes and wherein the second IRS immune system biomarker gene is selected from group P IRS immune system biomarker genes.

In another broad form the present invention seeks to provide a method for inhibiting the development or progression in a subject of at least one condition selected from the group consisting of inSIRS and ipSIRS, the method comprising: exposing the subject to a treatment regimen for treating the at least one condition based on an indicator obtained from an indicator-determining method, wherein the indicator is indicative of the presence of the at least one condition in the subject, the indicator-determining method comprising: (a) determining at least one pair of biomarker values, each biomarker value being a value measured or derived for at least one corresponding immune system biomarker of the biological subject and being at least partially indicative of a concentration of the immune system biomarker in a sample taken from the subject, (b) determining at least one derived biomarker value using the at least one pair of biomarker values, the derived biomarker value being indicative of a ratio of concentrations of the at least one pair of immune system biomarkers; and (c) determining the indicator based on the at least one derived biomarker value, wherein the pair of biomarker values comprises at least one of:

a) a first pair of biomarker values comprising first and second biomarker values corresponding to first and second biomarkers, wherein the first immune system biomarker represents a polynucleotide expression product of the PLA2G7 gene and wherein the second immune system biomarker representing a polynucleotide expression product of the PLAC8 gene, and b) a second pair of biomarker values comprises third and fourth biomarker values corresponding to third and fourth immune system biomarkers, respectively, wherein the third immune system biomarker represents a polynucleotide expression product of the CEACAM4 gene and wherein the fourth immune system biomarker represents a polynucleotide expression product of the LAMP1 gene.

Typically the indicator-determining method comprises: determining the first pair and second pair of biomarker values and determining a first derived biomarker value calculated using the first pair of biomarker values and a second derived biomarker value calculated using the second pair of biomarker values; and determining the indicator based on a combination of the first and second derived biomarker values.

In another broad form the present invention seeks to provide a method for inhibiting the development or progression of inSIRS in a subject, the method comprising: exposing the subject to a treatment regimen for treating inSIRS based on an indicator obtained from an indicator-determining method, wherein the indicator is indicative of the presence of inSIRS in the subject, the indicator-determining method comprising: (a) determining at least one pair of biomarker values, each biomarker value being a value measured or derived for at least one corresponding immune system biomarker of the biological subject and being at least partially indicative of a concentration of the immune system biomarker in a sample taken from the subject, (b) determining at least one derived biomarker value using the at least one pair of biomarker values, the derived biomarker value being indicative of a ratio of concentrations of the pair of immune system biomarkers; and (c) determining the indicator based on the at least one derived biomarker value, wherein the at least one pair of biomarker values comprises first and second biomarker values corresponding to first and second immune system biomarkers, respectively, wherein the first immune system biomarker represents a polynucleotide expression product of a first IRS immune system biomarker gene, and wherein the second immune system biomarker represents a polynucleotide expression product of a second IRS immune system biomarker gene, wherein the first IRS immune system biomarker gene is selected from group A IRS immune system biomarker genes and wherein the second IRS immune system biomarker gene is selected from group B IRS immune system biomarker genes.

In another broad form the present invention seeks to provide a method for inhibiting the development or progression of ipSIRS in a subject, the method comprising: exposing the subject to a treatment regimen for treating ipSIRS based on an indicator obtained from an indicator-determining method, wherein the indicator is indicative of the presence of ipSIRS in the subject, the indicator-determining method comprising: (a) determining at least one pair of biomarker values, each biomarker value being a value measured or derived for at least one corresponding immune system biomarker of the biological subject and being at least partially indicative of a concentration of the immune system biomarker in a sample taken from the subject, (b) determining at least one derived biomarker value using the at least one pair of biomarker values, the derived biomarker value being indicative of a ratio of concentrations of the at least one pair of immune system biomarkers; and (c) determining the indicator based on the at least one derived biomarker value, wherein the at least one pair of biomarker values comprises first and second biomarker values corresponding to first and second immune system biomarkers, respectively, wherein the first immune system biomarker represents a polynucleotide expression product of a first IRS immune system biomarker gene, and wherein the second immune system biomarker represents a polynucleotide expression product of a second IRS immune system biomarker gene, wherein the first IRS immune system biomarker gene is selected from group C IRS immune system biomarker genes and wherein the second IRS immune system biomarker gene is selected from group D IRS immune system biomarker genes.

In another broad form the present invention seeks to provide a method for inhibiting the development or progression in a subject of at least one condition selected from the group consisting of inSIRS and ipSIRS, the method comprising: exposing the subject to a treatment regimen for treating the at least one condition based on an indicator obtained from an indicator-determining method, wherein the indicator is indicative of the presence of the at least one condition in the subject, the indicator-determining method comprising: (a) determining at least one pair of biomarker values, each biomarker value being a value measured or derived for at least one corresponding immune system biomarker of the biological subject and being at least partially indicative of a concentration of the immune system biomarker in a sample taken from the subject, (b) determining at least one derived biomarker value using the at least one pair of biomarker values, the derived biomarker value being indicative of a ratio of concentrations of the at least one pair of immune system biomarkers; and (c) determining the indicator based on the at least one derived biomarker value, wherein the at least one pair of biomarker values comprises first and second biomarker values corresponding to of first and second immune system biomarkers, respectively, wherein the first immune system biomarker represents a polynucleotide expression product of a first IRS immune system biomarker gene, and wherein the second immune system biomarker represents a polynucleotide expression product of a second IRS immune system biomarker gene, wherein the first IRS immune system biomarker gene is selected from group E IRS immune system biomarker genes and wherein the second IRS immune system biomarker gene is selected from group F IRS immune system biomarker genes.

In another broad form the present invention seeks to provide a method for inhibiting the development or progression in a subject of at least one condition selected from the group consisting of inSIRS and ipSIRS, the method comprising: exposing the subject to a treatment regimen for treating the at least one condition based on an indicator obtained from an indicator-determining method, wherein the indicator is indicative of the presence of the at least one condition in the subject, the indicator-determining method comprising: (a) determining at least two pairs of biomarker values, each biomarker value being a value measured or derived for at least one corresponding immune system biomarker of the biological subject and being at least partially indicative of a concentration of the immune system biomarker in a sample taken from the subject, (b) determining at least two derived biomarker values using the at least two pairs of biomarker values, the derived biomarker value being indicative of a ratio of concentrations of each pair of immune system biomarkers; and (c) determining the indicator based on the at least two derived biomarker values, wherein the at least one pair of biomarker values comprises a first pair of biomarker values comprising first and second biomarker values corresponding to first and second immune system biomarkers, respectively, wherein the first immune system biomarker represents a polynucleotide expression product of a first IRS immune system biomarker gene and wherein the second immune system biomarker represents a polynucleotide expression product of a second IRS immune system biomarker gene, and a second pair of biomarker values comprising third and fourth biomarker values corresponding to third and fourth immune system biomarkers, respectively, wherein the third immune system biomarker represents a polynucleotide expression product of a third IRS immune system biomarker gene and wherein the fourth immune system biomarker represents a polynucleotide expression product of a fourth IRS immune system biomarker gene, wherein the first IRS immune system biomarker gene is selected from group G IRS immune system biomarker genes, wherein the second IRS immune system biomarker gene is selected from group H IRS immune system biomarker genes, wherein the third IRS immune system biomarker gene is selected from group I IRS immune system biomarker genes, and wherein the fourth IRS immune system biomarker gene is selected from group J IRS immune system biomarker genes.

In another broad form the present invention seeks to provide a method for inhibiting the development or progression in a subject of at least one condition selected from the group consisting of mild sepsis and severe sepsis, the method comprising: exposing the subject to a treatment regimen for treating the at least one condition based on an indicator obtained from an indicator-determining method, wherein the indicator is indicative of the presence of the at least one condition in the subject, the indicator-determining method comprising: (a) determining at least one pair of biomarker values, each biomarker value being a value measured or derived for at least one corresponding immune system biomarker of the biological subject and being at least partially indicative of a concentration of the immune system biomarker in a sample taken from the subject, (b) determining at least one derived biomarker value using the at least one pair of biomarker values, the derived biomarker value being indicative of a ratio of concentrations of the at least one pair of immune system biomarkers; and (c) determining the indicator based on the at least one derived biomarker value, wherein the at least one pair of biomarker values comprises first and second biomarker values corresponding to first and second immune system biomarkers, respectively, wherein the first immune system biomarker represents a polynucleotide expression product of a first IRS immune system biomarker gene, and wherein the second immune system biomarker represents a polynucleotide expression product of a second IRS immune system biomarker gene, wherein the first IRS immune system biomarker gene is selected from group K IRS immune system biomarker genes and wherein the second IRS immune system biomarker gene is selected from group L IRS immune system biomarker genes.

In another broad form the present invention seeks to provide a method for inhibiting the development or progression in a subject of at least one condition selected from the group consisting of mild sepsis and septic shock, the method comprising: exposing the subject to a treatment regimen for treating the at least one condition based on an indicator obtained from an indicator-determining method, wherein the indicator is indicative of the presence of the at least one condition in the subject, the indicator-determining method comprising: (a) determining at least one pair of biomarker values, each biomarker value being a value measured or derived for at least one corresponding immune system biomarker of the biological subject and being at least partially indicative of a concentration of the immune system biomarker in a sample taken from the subject, (b) determining at least one derived biomarker value using the at least one pair of biomarker values, the derived biomarker value being indicative of a ratio of concentrations of the at least one pair of immune system biomarkers; and (c) determining the indicator based on the at least one derived biomarker value, wherein the at least one pair of biomarker values comprises first and second biomarker values corresponding to first and second immune system biomarkers, respectively, wherein the first immune system biomarker represents a polynucleotide expression product of a first IRS immune system biomarker gene, and wherein the second immune system biomarker represents a polynucleotide expression product of a second IRS immune system biomarker gene, wherein the first IRS immune system biomarker gene is selected from group M IRS immune system biomarker genes and wherein the second IRS immune system biomarker gene is selected from group N IRS immune system biomarker genes.

In another broad form the present invention seeks to provide a method for inhibiting the development or progression in a subject of at least one condition selected from the group consisting of severe sepsis and septic shock, the method comprising: exposing the subject to a treatment regimen for treating the at least one condition based on an indicator obtained from an indicator-determining method, wherein the indicator is indicative of the presence of the at least one condition in the subject, the indicator-determining method comprising: (a) determining at least one pair of biomarker values, each biomarker value being a value measured or derived for at least one corresponding immune system biomarker of the biological subject and being at least partially indicative of a concentration of the immune system biomarker in a sample taken from the subject, (b) determining at least one derived biomarker value using the at least one pair of biomarker values, the derived biomarker value being indicative of a ratio of concentrations of the at least one pair of immune system biomarkers; and (c) determining the indicator based on the at least one derived biomarker value, wherein the at least one pair of biomarker values comprises first and second biomarker values corresponding to first and second immune system biomarkers, respectively, wherein the first immune system biomarker represents a polynucleotide expression product of a first IRS immune system biomarker gene, and wherein the second immune system biomarker represents a polynucleotide expression product of a second IRS immune system biomarker gene, wherein the first IRS immune system biomarker gene is selected from group O IRS immune system biomarker genes and wherein the second IRS immune system biomarker gene is selected from group P IRS immune system biomarker genes.

In some embodiments, the method comprises taking the sample from the subject and obtaining the indicator according to the indicator-determining method.

In some embodiments, the method comprises: sending the sample taken from the subject to a laboratory at which the indicator is determined.

Typically, the sample comprises cells obtained from the subject or a nucleic acid sample thereof.

In another broad form the present invention seeks to provide a method for differentiating between inSIRS and ipSIRS in a biological subject, the method including:
  a) obtaining a sample taken from a biological subject showing a clinical sign of SIRS, the sample including polynucleotide expression products;
  b) quantifying polynucleotide expression products within the sample to determine a pair of biomarker values, the pair of biomarker values being selected from the group consisting of:

i) a first pair of biomarker values indicative of a concentration of polynucleotide expression products of the PLA2G7 gene and PLAC8 gene;

ii) a second pair of biomarker values indicative of a concentration of polynucleotide expression products of the CEACAM4 gene and LAMP1 gene;

c) determining an indicator indicative of a ratio of concentrations of the polynucleotide expression products using the pair of biomarker values; and, d) comparing the indicator to first and second indicator references, the first and second indicator references being indicative of inSIRS and ipSIRS, respectively; and, e) determining a likelihood of the subject having inSIRS or ipSIRS in accordance with the results of the comparison.

In another broad form the present invention seeks to provide a method for differentiating between inSIRS and a healthy condition in a biological subject, the method including:

a) obtaining a sample taken from a biological subject showing a clinical sign of SIRS, the sample including polynucleotide expression products;

b) quantifying polynucleotide expression products within the sample to determine a pair of biomarker values, the pair of biomarker values being indicative of a concentration of polynucleotide expression products of a first IRS immune system biomarker gene and a second IRS immune system biomarker gene, wherein the first IRS immune system biomarker gene is selected from group A IRS immune system biomarker genes and wherein the second IRS immune system biomarker gene is selected from group B IRS immune system biomarker genes;

c) determining an indicator indicative of a ratio of concentrations of the polynucleotide expression products using the pair of biomarker values; and, d) comparing the indicator to first and second indicator references, the first and second indicator references being indicative of inSIRS and healthy condition, respectively; and, e) determining a likelihood of the subject having inSIRS or the healthy condition in accordance with the results of the comparison.

In another broad form the present invention seeks to provide a method for differentiating between ipSIRS and a healthy condition in a biological subject, the method including:

a) obtaining a sample taken from a biological subject showing a clinical sign of SIRS, the sample including polynucleotide expression products;

b) quantifying polynucleotide expression products within the sample to determine a pair of biomarker values, the pair of biomarker values being indicative of a concentration of polynucleotide expression products of a first IRS immune system biomarker gene and a second IRS immune system biomarker gene, wherein the first IRS immune system biomarker gene is selected from group C IRS immune system biomarker genes and wherein the second IRS immune system biomarker gene is selected from group D IRS immune system biomarker genes;

c) determining an indicator indicative of a ratio of concentrations of the polynucleotide expression products using the pair of biomarker values; and, d) comparing the indicator to first and second indicator references, the first and second indicator references being indicative of ipSIRS and healthy condition, respectively; and, e) determining a likelihood of the subject having ipSIRS or the healthy condition in accordance with the results of the comparison.

In another broad form the present invention seeks to provide a method for differentiating between inSIRS and ipSIRS in a biological subject, the method including:

a) obtaining a sample taken from a biological subject showing a clinical sign of SIRS, the sample including polynucleotide expression products;

b) quantifying polynucleotide expression products within the sample to determine a pair of biomarker values, the pair of biomarker values being indicative of a concentration of polynucleotide expression products of a first IRS immune system biomarker gene and a second IRS immune system biomarker gene, wherein the first IRS immune system biomarker gene is selected from group E IRS immune system biomarker genes and wherein the second IRS immune system biomarker gene is selected from group F IRS immune system biomarker genes;

c) determining an indicator indicative of a ratio of concentrations of the polynucleotide expression products using the pair of biomarker values; and, d) comparing the indicator to first and second indicator references, the first and second indicator references being indicative of inSIRS and ipSIRS, respectively; and, e) determining a likelihood of the subject having inSIRS or ipSIRS in accordance with the results of the comparison.

In another broad form the present invention seeks to provide a method for differentiating between inSIRS and ipSIRS in a biological subject, the method including:

a) obtaining a sample taken from a biological subject showing a clinical sign of SIRS, the sample including polynucleotide expression products;

b) quantifying polynucleotide expression products within the sample to determine a pair of biomarker values, the pair of biomarker values being selected from the group consisting of:

i) a first pair of biomarker values indicative of a concentration of polynucleotide expression products of a first IRS immune system biomarker gene and a second IRS immune system biomarker gene, wherein the first IRS immune system biomarker gene is selected from group G IRS immune system biomarker genes and wherein the second IRS immune system biomarker gene is selected from group H IRS immune system biomarker genes;

ii) a second pair of biomarker values indicative of a concentration of polynucleotide expression products of a third IRS immune system biomarker gene and a fourth IRS immune system biomarker gene, wherein the third IRS immune system biomarker gene is selected from group I IRS immune system biomarker genes and wherein the fourth IRS immune system biomarker gene is selected from group J IRS immune system biomarker genes;

c) determining an indicator indicative of a ratio of concentrations of the polynucleotide expression products using the pair of biomarker values; and, d) comparing the indicator to first and second indicator references, the first and second indicator references being indicative of inSIRS and ipSIRS, respectively; and, e) determining a likelihood of the subject having inSIRS or ipSIRS in accordance with the results of the comparison.

In another broad form the present invention seeks to provide a method for differentiating between mild sepsis and severe sepsis in a biological subject, the method including:

a) obtaining a sample taken from a biological subject showing a clinical sign of SIRS, the sample including polynucleotide expression products;

b) quantifying polynucleotide expression products within the sample to determine a pair of biomarker values, the pair of biomarker values being indicative of a concentration of polynucleotide expression products of a first IRS immune system biomarker gene and a second IRS immune system biomarker gene, wherein the first IRS immune system biomarker gene is selected from group K IRS immune system biomarker genes and wherein the second IRS immune system biomarker gene is selected from group L IRS immune system biomarker genes;

c) determining an indicator indicative of a ratio of concentrations of the polynucleotide expression products using the pair of biomarker values; and, d) comparing the indicator to first and second indicator references, the first and second indicator references being indicative of mild sepsis and severe sepsis, respectively; and, e) determining a likelihood of the subject having mild sepsis or severe sepsis in accordance with the results of the comparison.

In another broad form the present invention seeks to provide a method for differentiating between mild sepsis and septic shock in a biological subject, the method including:

a) obtaining a sample taken from a biological subject showing a clinical sign of SIRS, the sample including polynucleotide expression products;

b) quantifying polynucleotide expression products within the sample to determine a pair of biomarker values, the pair of biomarker values being indicative of a concentration of polynucleotide expression products of a first IRS immune system biomarker gene and a second IRS immune system biomarker gene, wherein the first IRS immune system biomarker gene is selected from group M IRS immune system biomarker genes and wherein the second IRS immune system biomarker gene is selected from group N IRS immune system biomarker genes;

c) determining an indicator indicative of a ratio of concentrations of the polynucleotide expression products using the pair of biomarker values; and, d) comparing the indicator to first and second indicator references, the first and second indicator references being indicative of mild sepsis and septic shock, respectively; and, e) determining a likelihood of the subject having mild sepsis or septic shock in accordance with the results of the comparison.

In another broad form the present invention seeks to provide a method for differentiating between severe sepsis and septic shock in a biological subject, the method including:

a) obtaining a sample taken from a biological subject showing a clinical sign of SIRS, the sample including polynucleotide expression products;

b) quantifying polynucleotide expression products within the sample to determine a pair of biomarker values, the pair of biomarker values being indicative of a concentration of polynucleotide expression products of a first IRS immune system biomarker gene and a second IRS immune system biomarker gene, wherein the first IRS immune system biomarker gene is selected from group O IRS immune system biomarker genes and wherein the second IRS immune system biomarker gene is selected from group P IRS immune system biomarker genes;

c) determining an indicator indicative of a ratio of concentrations of the polynucleotide expression products using the pair of biomarker values; and, d) comparing the indicator to first and second indicator references, the first and second indicator references being indicative of severe sepsis and septic shock, respectively; and, e) determining a likelihood of the subject having severe sepsis or septic shock in accordance with the results of the comparison.

Typically the method includes determining:

a) a first derived biomarker value indicative of a ratio of concentrations of the polynucleotide expression products using the first pair of biomarker values;

b) a second derived biomarker value indicative of a ratio of concentrations of the polynucleotide expression products using the first pair of biomarker values; and, c) determining the indicator by combining the first and second derived biomarker values.

Typically the first and second indicator references are distributions of indicators determined for first and second groups of a reference population, the first and second group consisting of individuals diagnosed with inSIRS and ipSIRS respectively.

In another broad form the present invention seeks to provide a method for determining an indicator used in assessing the likelihood of a biological subject having at least one medical condition, the method including:

a) obtaining a sample taken from a biological subject, the sample including polynucleotide expression products;

b) amplifying at least some polynucleotide expression products in the sample;

c) determining an amplification amount representing a degree of amplification required to obtain a defined level of each of a pair of polynucleotide expression products selected from the group consisting of:
   i) a first pair of polynucleotide expression products of the PLA2G7 gene and PLAC8 gene;
   ii) a second pair of polynucleotide expression products of the CEACAM4 gene and LAMP1 gene;

d) determining the indicator by determining a difference between the amplification amounts; and, e) using the indicator to assess the likelihood of a biological subject having a medical condition.

In another broad form the present invention seeks to provide a method for determining an indicator used in assessing the likelihood of a biological subject having at least one medical condition, the method including:

a) obtaining a sample taken from a biological subject, the sample including polynucleotide expression products;

b) amplifying at least some polynucleotide expression products in the sample;

c) determining an amplification amount representing a degree of amplification required to obtain a defined level of each of a pair of polynucleotide expression products selected from the group consisting of: a polynucleotide expression product of a first IRS immune system biomarker gene and a polynucleotide expression product of a second IRS immune system biomarker gene, wherein the first IRS immune system biomarker gene is selected from group A IRS immune system biomarker genes and wherein the second IRS immune system biomarker gene is selected from group B IRS immune system biomarker genes;

d) determining the indicator by determining a difference between the amplification amounts; and, e) using the indicator to assess the likelihood of a biological subject having a medical condition.

In another broad form the present invention seeks to provide a method for determining an indicator used in assessing the likelihood of a biological subject having at least one medical condition, the method including:

a) obtaining a sample taken from a biological subject, the sample including polynucleotide expression products;

b) amplifying at least some polynucleotide expression products in the sample;

c) determining an amplification amount representing a degree of amplification required to obtain a defined level of each of a pair of polynucleotide expression products selected from the group consisting of: a polynucleotide expression product of a first IRS immune system biomarker gene and a polynucleotide expression product of a second IRS immune system biomarker gene, wherein the first IRS immune system biomarker gene is selected from group C IRS immune system biomarker genes and wherein the second IRS immune system biomarker gene is selected from group D IRS immune system biomarker genes;

d) determining the indicator by determining a difference between the amplification amounts; and, e) using the indicator to assess the likelihood of a biological subject having a medical condition.

In another broad form the present invention seeks to provide a method for determining an indicator used in assessing the likelihood of a biological subject having at least one medical condition, the method including:

a) obtaining a sample taken from a biological subject, the sample including polynucleotide expression products;

b) amplifying at least some polynucleotide expression products in the sample;

c) determining an amplification amount representing a degree of amplification required to obtain a defined level of each of a pair of polynucleotide expression products selected from the group consisting of: a polynucleotide expression product of a first IRS immune system biomarker gene and a polynucleotide expression product of a second IRS immune system biomarker gene, wherein the first IRS immune system biomarker gene is selected from group E IRS immune system biomarker genes and wherein the second IRS immune system biomarker gene is selected from group F IRS immune system biomarker genes;

d) determining the indicator by determining a difference between the amplification amounts; and, e) using the indicator to assess the likelihood of a biological subject having a medical condition.

In another broad form the present invention seeks to provide a method for determining an indicator used in assessing the likelihood of a biological subject having at least one medical condition, the method including:

a) obtaining a sample taken from a biological subject, the sample including polynucleotide expression products;

b) amplifying at least some polynucleotide expression products in the sample;

c) determining an amplification amount representing a degree of amplification required to obtain a defined level of each of a pair of polynucleotide expression products selected from the group consisting of:
  i) a first pair of polynucleotide expression products of a first IRS immune system biomarker gene and a second IRS immune system biomarker gene, wherein the first IRS immune system biomarker gene is selected from group G IRS immune system biomarker genes and wherein the second IRS immune system biomarker gene is selected from group H IRS immune system biomarker genes;
  ii) a second pair of polynucleotide expression products of a third IRS immune system biomarker gene and a fourth IRS immune system biomarker gene, wherein the third IRS immune system biomarker gene is selected from group I IRS immune system biomarker genes and wherein the fourth IRS immune system biomarker gene is selected from group J IRS immune system biomarker genes;

d) determining the indicator by determining a difference between the amplification amounts; and, e) using the indicator to assess the likelihood of a biological subject having a medical condition.

In another broad form the present invention seeks to provide a method for determining an indicator used in assessing the likelihood of a biological subject having at least one medical condition, the method including:

a) obtaining a sample taken from a biological subject, the sample including polynucleotide expression products;

b) amplifying at least some polynucleotide expression products in the sample;

c) determining an amplification amount representing a degree of amplification required to obtain a defined level of each of a pair of polynucleotide expression products selected from the group consisting of: a polynucleotide expression product of a first IRS immune system biomarker gene and a polynucleotide expression product of a second IRS immune system biomarker gene, wherein the first IRS immune system biomarker gene is selected from group K IRS immune system biomarker genes and wherein the second IRS immune system biomarker gene is selected from group L IRS immune system biomarker genes;

d) determining the indicator by determining a difference between the amplification amounts; and, e) using the indicator to assess the likelihood of a biological subject having a medical condition.

In another broad form the present invention seeks to provide a method for determining an indicator used in assessing the likelihood of a biological subject having at least one medical condition, the method including:

a) obtaining a sample taken from a biological subject, the sample including polynucleotide expression products;

b) amplifying at least some polynucleotide expression products in the sample;

c) determining an amplification amount representing a degree of amplification required to obtain a defined level of each of a pair of polynucleotide expression products selected from the group consisting of: a polynucleotide expression product of a first IRS immune system biomarker gene and a polynucleotide expression product of a second IRS immune system biomarker gene, wherein the second IRS immune system biomarker gene is selected from group M IRS immune system biomarker genes and wherein the second IRS immune system biomarker gene is selected from group N IRS immune system biomarker genes;

d) determining the indicator by determining a difference between the amplification amounts; and, e) using the indicator to assess the likelihood of a biological subject having a medical condition.

In another broad form the present invention seeks to provide a method for determining an indicator used in assessing the likelihood of a biological subject having at least one medical condition, the method including:

a) obtaining a sample taken from a biological subject, the sample including polynucleotide expression products;

b) amplifying at least some polynucleotide expression products in the sample;

c) determining an amplification amount representing a degree of amplification required to obtain a defined level of each of a pair of polynucleotide expression products selected from the group consisting of: a polynucleotide expression product of a first IRS immune system biomarker gene and a polynucleotide expression product of a second IRS immune system biomarker gene, wherein the first IRS immune system biomarker gene is selected from group O IRS immune system biomarker genes and wherein the second IRS immune system biomarker gene is selected from group P IRS immune system biomarker genes;

d) determining the indicator by determining a difference between the amplification amounts; and, e) using the indicator to assess the likelihood of a biological subject having a medical condition.

Typically the method includes determining:

a) a first derived biomarker value by determining a difference between the amplification amounts of the first pair of polynucleotide expression products;

b) a second derived biomarker value by determining a difference between the amplification amounts of the second pair of polynucleotide expression products;

c) determining the indicator by adding the first and second derived biomarker values.

Typically the method includes determining:

a) comparing the indicator to first and second indicator references, wherein the first and second indicator references are distributions of indicators determined for first and second groups of a reference population, one of the first and second groups consisting of individuals diagnosed with the medical condition; and, b) determining a likelihood of the subject having the medical condition in accordance with the results of the comparison.

Typically the amplification amount is at least one of:

a) a cycle time;

b) a number of cycles;

c) a cycle threshold;

d) an amplification time; and, e) relative to an amplification amount of another amplified product.

In another broad form the present invention seeks to provide a method for use in assessing the likelihood of a biological subject having a medical condition, the method including, in one or more processing devices:

a) determining a pair of biomarker values, the pair of biomarker values being selected from the group consisting of:

i) a first pair of biomarker values indicative of a concentration of polynucleotide expression products of the PLA2G7 gene and PLAC8 gene;

ii) a second pair of biomarker values indicative of a concentration of polynucleotide expression products of the CEACAM4 gene and LAMP1 gene;

b) determining an indicator indicative of a ratio of the concentrations of the polynucleotide expression products using the pair of biomarker values;

c) retrieving previously determined first and second indicator references from a database, the first and second indicator references being determined based on indicators determined from first and second groups of a reference population, one of the groups consisting of individuals diagnosed with the medical condition;

d) comparing the indicator to the first and second indicator references;

e) using the results of the comparison to determine a probability indicative of the subject having the medical condition; and, f) generating a representation of the probability, the representation being displayed to a user to allow the user to assess the likelihood of a biological subject having at least one medical condition.

Typically the method includes determining:

a) a first derived biomarker value indicative of a ratio of concentrations of the polynucleotide expression products using the first pair of biomarker values;

b) a second derived biomarker value indicative of a ratio of concentrations of the polynucleotide expression products using the first pair of biomarker values; and, c) determining the indicator by combining the first and second derived biomarker values.

In another broad form the present invention seeks to provide apparatus for determining an indicator used in determining the likelihood of a biological subject having at least one medical condition, the apparatus including:

a) a sampling device that obtains a sample taken from a biological subject, the sample including polynucleotide expression products;

b) a measuring device that quantifies polynucleotide expression products within the sample to determine a pair of biomarker values, the pair of biomarker values being selected from the group consisting of:

i) a first pair of biomarker values indicative of a concentration of polynucleotide expression products of the PLA2G7 gene and PLAC8 gene;

ii) a second pair of biomarker values indicative of a concentration of polynucleotide expression products of the CEACAM4 gene and LAMP1 gene;

c) at least one processing device that:

i) receives an indication of the pair of biomarker values from the measuring device;

ii) determines an indicator using a ratio of the concentration of the first and second polynucleotide expression products using the biomarker values; and, iii) compares the indicator to at least one indicator reference; and, iv) determines a likelihood of the subject having the at least one medical condition using the results of the comparison; and, v) generates a representation of the indicator and the likelihood for display to a user.

In another broad form the present invention seeks to provide a method for differentiating between inSIRS and ipSIRS in a biological subject, the method including:
a) obtaining a sample taken from a biological subject showing a clinical sign of SIRS, the sample including polynucleotide expression products;
b) in a measuring device:
  i) amplifying at least some polynucleotide expression products in the sample;
  ii) determining an amplification amount representing a degree of amplification required to obtain a defined level of polynucleotide expression products including:
    (1) amplification amounts for a first pair of polynucleotide expression products of the PLA2G7 gene and PLAC8 gene;
    (2) amplification amounts for a second pair of polynucleotide expression products of the CEACAM4 gene and LAMP1 gene;
c) in a processing system:
  i) retrieving the amplification amounts;
  ii) determining an indicator by:
    (1) determining a first derived biomarker value indicative of a ratio of concentrations of the first pair of polynucleotide expression products by determining a difference between the amplification amounts for the first pair;
    (2) determining a second derived biomarker value indicative of a ratio of concentrations of the second pair of polynucleotide expression products by determining a difference between the amplification amounts for the second pair;
    (3) determining the indicator by adding the first and second derived biomarker values;
  iii) retrieving previously determined first and second indicator references from a database, wherein the first and second indicator references are distributions of indicators determined for first and second groups of a reference population, the first and second group consisting of individuals diagnosed with inSIRS and ipSIRS respectively;
  iv) comparing the indicator to the first and second indicator references;
  v) using the results of the comparison to determine a probability of the subject being classified within the first or second group;
  vi) generating a representation at least partially indicative of the indicator and the probability; and,
  vii) providing the representation to a user to allow the user to assess the likelihood of a biological subject having at least one medical condition.

In another broad form the present invention seeks to provide a method for determining an indicator used in assessing a likelihood of a biological subject having a presence, absence, degree or prognosis of at least one medical condition, the method including:
a) determining a plurality of biomarker values, each biomarker value being indicative of a value measured or derived for at least one corresponding immune system biomarker of the biological subject and being at least partially indicative of a concentration of the immune system biomarker in a sample taken from the subject;
b) determining the indicator using a combination of the plurality of biomarker values, wherein:
  i) at least two biomarkers have a mutual correlation in respect of the at least one condition that lies within a mutual correlation range, the mutual correlation range being between ±0.9; and,
  ii) the indicator has a performance value greater than or equal to a performance threshold representing the ability of the indicator to diagnose the presence, absence, degree or prognosis of the at least one condition, the performance threshold being indicative of an explained variance of at least 0.3.

Typically the method includes:
c) determining a plurality of measured biomarker values, each measured biomarker value being a measured value of a corresponding biomarker of the biological subject; and,
d) determining the indicator by applying a function to at least one of the measured biomarker values to determine at least one derived biomarker value, the at least one derived biomarker value being indicative of a value of a corresponding derived biomarker.

Typically the function includes at least one of:
a) multiplying two biomarker values;
b) dividing two biomarker values;
c) adding two biomarker values;
d) subtracting two biomarker values;
e) a ratio of two biomarker values;
f) a weighted sum of at least two biomarker values;
g) a log sum of at least two biomarker values; and,
h) a sigmoidal function of at least two biomarker values.

Typically the method includes determining at least one derived biomarker value corresponding to a ratio of two measured biomarker values.

Typically the method includes combining at least two biomarker values to determine an indicator value representing the indicator.

Typically the method includes combining at least two biomarker values using a combining function, the combining function being at least one of:
a) an additive model;
b) a linear model;
c) a support vector machine;
d) a neural network model;
e) a random forest model;
f) a regression model;
g) a genetic algorithm;
h) an annealing algorithm;
i) a weighted sum;
j) a nearest neighbor model; and,
k) a probabilistic model.

Typically at least one of the at least two biomarkers is a derived biomarker.

Typically the method includes:
a) determining a first derived biomarker value, the first derived biomarker value being indicative of a ratio of concentrations of the first and second immune system biomarkers;
b) determining a second derived biomarker value, the second derived biomarker value being indicative of a ratio of concentrations of the third and fourth measured immune system biomarkers; and,
c) adding the first and second derived biomarker values to generate an indicator value.

Typically the method is performed at least in part using an electronic processing device.

Typically the method includes, in the electronic processing device:
a) receiving a plurality of measured biomarker values, each measured biomarker value being a measured value of a corresponding immune system biomarker;

b) applying a function to at least one of the measured biomarker values to determine at least one derived biomarker value, the at least one derived biomarker value being indicative of a value of a corresponding derived biomarker; and, c) combining at least one derived biomarker value and at least one other biomarker value to determine the indicator.

Typically the mutual correlation range is at least one of:
a) ±0.8;
b) ±0.7;
c) ±0.6;
d) ±0.5;
e) ±0.4;
f) ±0.3;
g) ±0.2; and,
h) ±0.1.

Typically each biomarker has a condition correlation with the presence, absence, degree or prognosis of the at least one condition that lies outside a condition correlation range, the condition correlation range being between ±0.3.

Typically the condition correlation range is at least one of:
a) ±0.9;
b) ±0.8;
c) ±0.7;
d) ±0.6;
e) ±0.5; and,
f) ±0.4.

Typically the performance threshold is indicative of an explained variance of at least one of:
a) 0.4;
b) 0.5;
c) 0.6;
d) 0.7;
e) 0.8; and,
f) 0.9.

Typically the biomarker value is indicative of a level or abundance of a molecule selected from one or more of a nucleic acid molecule and a proteinaceous molecule.

Typically the method includes generating a representation of the indicator.

Typically the representation includes:
a) an alphanumeric indication of the indicator;
b) a graphical indication of a comparison of the indicator to one or more indicator references;
c) an alphanumeric indication of a likelihood of the subject having at least one medical condition.

Typically the method includes:
a) comparing the indicator to an indicator reference; and,
b) determining a likelihood in accordance with results of the comparison.

Typically the indicator reference is based on at least one of:
a) an indicator threshold range;
b) an indicator threshold; and,
c) an indicator distribution.

Typically the indicator reference is derived from indicators determined for a number of individuals in a reference population.

Typically the indicator reference is based on a distribution of indicators determined for a group of a reference population, the group consisting of individuals diagnosed with the medical condition.

Typically the reference population includes:
a) a plurality of individuals of different sexes;
b) a plurality of individuals of different ethnicities;
c) a plurality of healthy individuals;
d) a plurality of individuals suffering from at least one diagnosed medical condition;
e) a plurality of individuals showing clinical signs of at least one medical condition; and,
f) first and second groups of individuals, each group of individuals suffering from a respective diagnosed medical condition.

Typically the indicator is for use in determining the likelihood that a biological subject has at least one medical condition, and wherein the reference population includes:
a) individuals presenting with clinical signs of the at least one medical condition;
b) individuals diagnosed with the at least one medical condition; and,
c) healthy individuals.

Typically the indicator reference is retrieved from a database.

Typically the likelihood is based on a probability generated using the results of the comparison.

Typically the indicator is for determining a likelihood of the subject having a first or second condition, and wherein the method includes:
a) comparing the indicator to first and second indicator references, the first and second indicator references being indicative of first and second conditions; and,
b) determining the likelihood in accordance with the results of the comparison.

Typically the method includes:
a) determining first and second indicator probabilities using the results of the comparisons; and,
b) combining the first and second indicator probabilities to determine a condition probability indicative of the likelihood.

Typically the first and second indicator references are distributions of indicators determined for first and second groups of a reference population, the first and second group consisting of individuals diagnosed with the first or second condition respectively.

Typically the method includes:
a) obtaining a sample taken from the biological subject, the sample including polynucleotide expression products;
b) quantifying at least some of the polynucleotide expression products within the sample to determine at least a pair of biomarker values;
c) determining the indicator at least in part using the pair of biomarker values;

Typically the method includes, determining the indicator at least in part using a ratio of concentrations of the polynucleotide expression products.

Typically the method includes:
a) quantifying polynucleotide expression products by:
b) amplifying at least some polynucleotide expression products in the sample; and,
c) determining an amplification amount representing a degree of amplification required to obtain a defined level of each of a pair of polynucleotide expression products; and,
d) determining the indicator by determining a difference between the amplification amounts.

Typically the amplification amount is at least one of:
a) a cycle time;
b) a number of cycles;
c) a cycle threshold;
d) an amplification time; and,
e) relative to an amplification amount of another amplified product.

Typically the method includes determining:
a) a first derived biomarker value by determining a difference between the amplification amounts of a first pair of polynucleotide expression products;
b) a second derived biomarker value by determining a difference between the amplification amounts of a second pair of polynucleotide expression products;
c) determining the indicator by adding the first and second derived biomarker values.

Typically the immune system biomarker is an IRS biomarker of an immune system of the biological subject that is altered, or whose level of expression is altered, as part of an inflammatory response to damage or pathogenic insult.

Typically the indicator is for determining a likelihood of the subject having at least one of inSIRS and ipSIRS, and wherein the method includes:
a) determining a first pair of biomarker values indicative of a concentration of polynucleotide expression products of the PLA2G7 gene and PLAC8 gene;
b) determining a second pair of biomarker values indicative of a concentration of polynucleotide expression products of the CEACAM4 gene and LAMP1 gene; and,
c) determining the indicator using the first and second pairs of biomarker values.

Typically the indicator is for determining a likelihood of the subject having inSIRS or ipSIRS, and wherein the method includes:
a) determining a first pair of biomarker values indicative of a concentration of polynucleotide expression products of the PLA2G7 gene and PLAC8 gene;
b) determining a second pair of biomarker values indicative of a concentration of polynucleotide expression products of the CEACAM4 gene and LAMP1 gene; and,
c) determining the indicator using the first and second pairs of biomarker values.

Typically the indicator is for determining a likelihood of the subject having inSIRS or a healthy condition, and wherein biomarker values are determined from at least one IRS immune system biomarker in each of first and second IRS immune system biomarker groups, wherein:
a) the first IRS immune system biomarker group consists of polynucleotide and/or polypeptide expression products from group A IRS immune system biomarker genes; and
b) the second IRS immune system biomarker group consists of polynucleotide and/or polypeptide expression products from group B IRS immune system biomarker genes.

Typically the indicator is for determining a likelihood of the subject having ipSIRS or a healthy condition, and wherein biomarker values are determined from at least one IRS immune system biomarker in each of first and second IRS immune system biomarker groups, wherein:
a) the first IRS immune system biomarker group consists of polynucleotide and/or polypeptide expression products from group C IRS immune system biomarker genes; and,
b) the second IRS immune system biomarker group consists of polynucleotide and/or polypeptide expression products from group D IRS immune system biomarker genes.

Typically the indicator is for determining a likelihood of the subject having inSIRS or ipSIRS, and wherein biomarker values are determined from at least one IRS immune system biomarker in each of first and second IRS immune system biomarker groups, wherein:
a) the first IRS immune system biomarker group consists of polynucleotide and/or polypeptide expression products from group E IRS immune system biomarker genes; and,
b) the second IRS immune system biomarker group consists of polynucleotide and/or polypeptide expression products from group F IRS immune system biomarker genes.

Typically the indicator is for determining a likelihood of the subject having inSIRS or ipSIRS, and wherein biomarker values are determined from at least one IRS immune system biomarker in each of first, second, third and fourth IRS immune system biomarker groups, wherein:
a) the first IRS immune system biomarker group consists of polynucleotide and/or polypeptide expression products from group G IRS immune system biomarker genes;
b) the second IRS immune system biomarker group consists of polynucleotide and/or polypeptide expression products from group H IRS immune system biomarker genes;
c) the third IRS immune system biomarker group consists of polynucleotide and/or polypeptide expression products from group I IRS immune system biomarker genes; and,
d) the fourth IRS immune system biomarker group consists of polynucleotide and/or polypeptide expression products from group J IRS immune system biomarker genes.

Typically the first IRS immune system biomarker is a PLA2G7 expression product, the second IRS immune system biomarker is a PLAC8 expression product, the third IRS immune system biomarker is a CEACAM4 expression product and the fourth IRS immune system biomarker is a LAMP1 expression product.

Typically the indicator is for determining a likelihood of the subject having mild sepsis or severe sepsis, and wherein biomarker values are determined from at least one IRS immune system biomarker in each of first and second IRS immune system biomarker groups, wherein:
a) the first IRS immune system biomarker group consists of polynucleotide and/or polypeptide expression products from group K IRS immune system biomarker genes; and,
b) the second IRS immune system biomarker group consists of polynucleotide and/or polypeptide expression products from group L IRS immune system biomarker genes.

Typically the indicator is for determining a likelihood of the subject having mild sepsis or septic shock, and wherein biomarker values are determined from at least one IRS immune system biomarker in each of first and second IRS immune system biomarker groups, wherein:
a) the first IRS immune system biomarker group consists of polynucleotide and/or polypeptide expression products from group M IRS immune system biomarker genes; and,
b) the second IRS immune system biomarker group consists of polynucleotide and/or polypeptide expression products from group N IRS immune system biomarker genes.

Typically the indicator is for determining a likelihood of the subject having severe sepsis or septic shock, and wherein biomarker values are determined from at least one IRS immune system biomarker in each of first and second IRS immune system biomarker groups, wherein:
  a) the first IRS immune system biomarker group consists of polynucleotide and/or polypeptide expression products from group O IRS immune system biomarker genes; and,
  b) the second IRS immune system biomarker group consists of polynucleotide and/or polypeptide expression products from group P IRS immune system biomarker genes.

In another broad form the present invention seeks to provide apparatus for determining an indicator used in assessing a likelihood of a biological subject having a presence, absence, degree or prognosis of at least one medical condition, the apparatus including a processing device that:
  a) determines a plurality of biomarker values, each biomarker value being indicative of a value measured or derived for at least one corresponding immune system biomarker of the biological subject and being at least partially indicative of a concentration of the immune system biomarker in a sample taken from the subject;
  b) determines the indicator using a combination of the plurality of biomarker values, wherein:
    i) at least two biomarkers have a mutual correlation in respect of the at least one condition that lies within a mutual correlation range, the mutual correlation range being between ±0.9; and,
    ii) the indicator has a performance value greater than or equal to a performance threshold representing the ability of the indicator to diagnose the presence, absence, degree or prognosis of the at least one condition, the performance threshold being indicative of an explained variance of at least 0.3.

In one broad form the present invention seeks to provide a method for determining an indicator for use in diagnosing the presence, absence, degree or prognosis of at least one condition in a biological subject, the method including:
  a) determining a plurality of biomarker values, each biomarker value being indicative of a value measured or derived for at least one corresponding biomarker of the biological subject;
  b) determining the indicator using a combination of the plurality of biomarker values, the at least one indicator being at least partially indicative of the presence, absence, degree or prognosis of the at least one condition, wherein:
    i) at least two markers have a mutual correlation in respect of the at least one condition that lies within a mutual correlation range, the mutual correlation range being between ±0.9; and,
    ii) the indicator has a performance value greater than or equal to a performance threshold representing the ability of the indicator to diagnose the presence, absence, degree or prognosis of the at least one condition, the performance threshold being indicative of an explained variance of at least 0.3.

Typically the method includes:
a) determining a plurality of measured biomarker values, each measured biomarker value being a measured value of a corresponding biomarker of the biological subject; and,
b) applying a function to at least one of the measured biomarker values to determine at least one derived biomarker value, the at least one derived biomarker value being indicative of a value of a corresponding derived biomarker.

Typically the function includes at least one of:
a) multiplying two biomarker values;
b) dividing two biomarker values;
c) adding two biomarker values;
d) subtracting two biomarker values;
e) a weighted sum of at least two biomarker values;
f) a log sum of at least two biomarker values; and,
g) a sigmoidal function of at least two biomarker values.

Typically the method includes determining at least one derived biomarker value corresponding to a ratio of two measured biomarker values.

Typically the method includes combining at least two biomarker values to determine an indicator value representing the indicator.

Typically the method includes combining at least two biomarker values using a combining function, the combining function being at least one of:
a) an additive model;
b) a linear model;
c) a support vector machine;
d) a neural network model;
e) a random forest model;
f) a regression model;
g) a genetic algorithm;
h) an annealing algorithm;
i) a weighted sum;
j) a nearest neighbor model; and,
k) a probabilistic model.

Typically at least one of the at least two biomarkers is a derived biomarker.

Typically the method includes:
a) determining a first derived biomarker value, the first derived biomarker value being a ratio of first and second measured biomarker values;
b) determining a second derived biomarker value, the second derived biomarker value being a ratio of third and fourth measured biomarker values; and,
c) adding the first and second derived biomarker values to generate an indicator value.

Typically the method includes:
a) determining an indicator value;
b) comparing the indicator value to at least one indicator value range; and,
c) using a result of the comparison in diagnosing the presence, absence, degree or prognosis of at least one condition.

Typically the method is performed at least in part using an electronic processing device.

Typically the method includes, in the electronic processing device:
a) receiving a plurality of measured biomarker values, each measured biomarker value being a measured value of a corresponding biomarker of the biological subject;
b) applying a function to at least one of the measured biomarker values to determine at least one derived biomarker value, the at least one derived biomarker value being indicative of a value of a corresponding derived biomarker; and,
c) combining at least one derived biomarker value and at least one other biomarker value to determine an indicator value.

Typically the method includes generating a representation in accordance with the at least one indicator value.

Typically the method includes:
a) comparing the indicator value to at least one indicator value range; and,
b) displaying a result of the comparison.

Typically the mutual correlation range is at least one of:
a) ±0.8;
b) ±0.7;
c) ±0.6;
d) ±0.5;
e) ±0.4;
f) ±0.3;
g) ±0.2; and,
h) ±0.1.

Typically each biomarker has a condition correlation with the presence, absence, degree or prognosis of the at least one condition that lies outside a condition correlation range, the condition correlation range being between ±0.3.

Typically the condition correlation range is at least one of:
a) ±0.9;
b) ±0.8;
c) ±0.7;
d) ±0.6;
e) ±0.5; and,
f) ±0.4.

Typically the performance threshold is indicative of an explained variance of at least one of:
a) 0.4;
b) 0.5;
c) 0.6;
d) 0.7;
e) 0.8; and,
f) 0.9.

Typically the biomarker value is indicative of a level or abundance of a molecule or entity selected from one or more of:
a) A nucleic acid molecule;
b) A proteinaceous molecule;
c) An amino acid
d) A carbohydrate;
e) A lipid;
f) A steroid;
g) An inorganic molecule;
h) An ion;
i) A drug;
j) A chemical;
k) A metabolite;
l) A toxin;
m) A nutrient;
n) A gas;
o) A cell;
p) A pathogenic organism; and,
q) A non-pathogenic organism.

In another broad form the present invention seeks to provide apparatus for determining an indicator for use in diagnosing the presence, absence, degree or prognosis of at least one condition in a biological subject, the apparatus including an electronic processing device that:
a) determines a plurality of biomarker values, each biomarker value being indicative of a value measured or derived for at least one corresponding biomarker of the biological subject;
b) determines the indicator using a combination of the plurality of biomarker values, the at least one indicator being at least partially indicative of the presence, absence, degree or prognosis of the at least one condition, wherein:
i) at least two biomarkers have a mutual correlation in respect of the at least one condition that lies within a mutual correlation range, the mutual correlation range being between ±0.9; and,
ii) the indicator has a performance value greater than or equal to a performance threshold representing the ability of the indicator to diagnose the presence, absence, degree or prognosis of the at least one condition, the performance threshold being indicative of an explained variance of at least 0.3.

In another broad form the present invention seeks to provide a diagnostic signature for use in diagnosing the presence, absence, degree or prognosis of at least one condition in a biological subject, the diagnostic signature defining a combination of at least two biomarker values corresponding to values of biomarkers that can be measured for or derived from the biological subject, wherein:
a) at least two biomarkers have a mutual correlation for the at least one condition that lies within a mutual correlation range, the mutual correlation range being between ±0.9; and,
b) the combination of at least two biomarker values has a performance value greater than or equal to a performance threshold representing the ability of the combination of the at least two biomarkers to diagnose the presence, absence, degree or prognosis of the at least one condition, the performance threshold being a variance explained of at least 0.3.

Typically the diagnostic signature defines a function to be applied to at least one measured biomarker value to determine at least one derived biomarker value, the at least one derived biomarker value being indicative of a value of a corresponding derived biomarker.

Typically the function includes at least one of:
a) multiplying two biomarker values;
b) dividing two biomarker values;
c) adding two biomarker values;
d) subtracting two biomarker values;
e) a weighted sum of at least two biomarker values;
f) a log sum of at least two biomarker values; and,
g) a sigmoidal function of at least two biomarker values.

Typically the at least one derived biomarker value corresponds to a ratio of two measured biomarker values.

Typically the diagnostic signature defines a combination of at least two biomarker values for determining an indicator value representing the indicator.

Typically the diagnostic signature defines a combining function for combining at least two biomarker values, the combining function being at least one of:
a) an additive model;
b) a linear model;
c) a support vector machine;
d) a neural network model;
e) a random forest model;
f) a regression model;
g) a genetic algorithm;
h) an annealing algorithm; and,
i) a weighted sum.

Typically at least one of the at least two biomarkers is a derived biomarker.

Typically the diagnostic signature defines:
a) a first derived biomarker value, the first derived biomarker value being a ratio of first and second measured biomarker values;
b) a second derived biomarker value, the second derived biomarker value being a ratio of third and fourth measured biomarker values; and,
c) a combination of the first and second derived biomarker values to generate an indicator value.

Typically the diagnostic signature defines at least one indicator value range and wherein comparison of at least one indicator value to the at least one indicator value range is used in diagnosing the presence, absence, degree or prognosis of at least one condition.

Typically the mutual correlation range is at least one of:
a) ±0.8;
b) ±0.7;
c) ±0.6;
d) ±0.5;
e) ±0.4;
f) ±0.3;
g) ±0.2; and,
h) ±0.1.

Typically each biomarker has a condition correlation with the presence, absence, degree or prognosis of the at least one condition that lies outside a condition correlation range, the condition correlation range being between ±0.3.

Typically the condition correlation range is at least one of:
a) ±0.9;
b) ±0.8;
c) ±0.7;
d) ±0.6;
e) ±0.5; and,
f) ±0.4.

Typically the performance threshold is indicative of an explained variance of at least one of:
a) 0.4;
b) 0.5;
c) 0.6;
d) 0.7;
e) 0.8; and,
f) 0.9.

Typically the biomarker value is indicative of a level or abundance of a molecule or entity selected from one or more of:
a) A nucleic acid molecule;
b) A proteinaceous molecule;
c) An amino acid
d) A carbohydrate;
e) A lipid;
f) A steroid;
g) An inorganic molecule;
h) An ion;
i) A drug;
j) A chemical;
k) A metabolite;
l) A toxin;
m) A nutrient;
n) A gas;
o) A cell;
p) A pathogenic organism; and,
q) A non-pathogenic organism.

In another broad form the present invention seeks to provide a method of identifying biomarkers for use in a diagnostic signature, the diagnostic signature being for use in diagnosing the presence, absence, degree or prognosis of at least one condition in a biological subject, the method including:
a) for a number of candidate biomarkers, ranking the candidate biomarkers in accordance with the ability of each biomarker to distinguish between the presence, absence, degree or prognosis of at least one condition in a biological subject;
b) selecting at least two candidate biomarkers in accordance with the ranking, the at least two biomarkers having a mutual correlation for the at least one condition that lies within a mutual correlation range, the mutual correlation range being between ±0.9;
c) determining a performance value of a combination of the at least two candidate biomarkers; and,
d) defining a diagnostic signature in accordance with the combination of the at least two biomarkers if the performance value is greater than or equal to a performance threshold representing the ability of the indicator to diagnose the presence, absence, degree or prognosis of the at least one condition, the performance threshold being indicative of an explained variance of at least 0.3.

Typically the method includes determining a combination of at least two candidate biomarkers using a combining function, the combining function being at least one of:
a) an additive model;
b) a linear model;
c) a support vector machine;
d) a neural network model;
e) a random forest model;
f) a regression model;
g) a genetic algorithm;
h) an annealing algorithm; and,
i) a weighted sum.

Typically the method includes:
a) selecting a next combining function;
b) determining if a performance value of a combination of the at least two candidate biomarkers determined by the next combining function is greater than or equal to a performance threshold; and,
c) if the performance value is not greater than or equal to a performance threshold, repeating steps a) and b) for successive combining functions.

Typically the method includes:
a) selecting two candidate biomarkers;
b) determining if a performance value of a combination of the two candidate biomarkers is greater than or equal to a performance threshold; and,
c) if the performance value is not greater than or equal to a performance threshold:
   i) combining the selected candidate biomarkers with at least one additional candidate biomarker; and,
   ii) repeating steps a) and b) with at least one additional candidate biomarker.

Typically the method includes combining a number of candidate biomarkers up to a limit.

Typically the method includes:
a) selecting a highest ranked candidate biomarker;
b) selecting a next highest ranked candidate biomarker;
c) for the selected candidate markers, determining if the mutual correlation for the candidate biomarkers within the mutual correlation range; and,
d) if not, repeating steps b) and c) until two candidate biomarkers are selected having a mutual correlation within the mutual correlation range.

Typically the method includes:
a) defining at least two groups of candidate biomarkers, candidate biomarkers in different groups having a mutual correlation within the mutual correlation range;
b) ranking the candidate biomarkers in each group; and,
c) selecting candidate biomarkers from the different groups.

Typically the method includes:
a) using reference data for at least one individual to define a number of groups indicative of the presence, absence, degree or prognosis of the at least one condition; and,
b) using at least one analysis technique to identify a number of candidate biomarkers that are potentially useful for distinguishing the groups.

Typically the method includes using reference values measured for reference biomarkers for the at least one individual to identify the candidate biomarkers.

Typically the method includes using reference values to filter reference biomarkers to determine candidate biomarkers.

Typically at least one of the candidate biomarkers is a derived biomarker derived from at least one of the reference biomarkers using a function.

Typically the derived biomarkers are derived from filtered biomarkers.

Typically the method includes:
a) applying a function to at least one of the reference values to determine at least one derived reference biomarker value, the at least one derived reference biomarker value being indicative of a value of a corresponding derived reference biomarker; and,
b) determining at least one candidate biomarker using the at least one derived reference biomarker value.

Typically the method includes:
a) using reference data for at least one individual to define a number of groups indicative of the presence, absence, degree or prognosis of the at least one condition; and,
b) for each group, combining a range of at least two reference biomarker values to determine an indicator value range for the group.

Typically the mutual correlation range is at least one of:
a) ±0.8;
b) ±0.7;
c) ±0.6;
d) ±0.5;
e) ±0.4;
f) ±0.3;
g) ±0.2; and,
h) ±0.1.

Typically each biomarker has a condition correlation with the presence, absence, degree or prognosis of the at least one condition that lies outside a condition correlation range, the condition correlation range being between ±0.3.

Typically the condition correlation range is at least one of:
a) ±0.9;
b) ±0.8;
c) ±0.7;
d) ±0.6;
e) ±0.5; and,
f) ±0.4.

Typically the performance threshold is indicative of an explained variance of at least one of:
a) 0.4;
b) 0.5;
c) 0.6;
d) 0.7;
e) 0.8; and,
f) 0.9.

In another broad form the present invention seeks to provide apparatus for identifying markers for use in a diagnostic signature, the diagnostic signature being for use in diagnosing the presence, absence, degree or prognosis of at least one condition in a biological subject, the apparatus including an electronic process device that:
a) for a number of candidate biomarkers, ranks the candidate biomarkers in accordance with the ability of each biomarker to distinguish between the presence, absence, degree or prognosis of at least one condition in a biological subject;
b) selects at least two candidate biomarkers in accordance with the ranking, the at least two biomarkers having a mutual correlation for the at least one condition that lies within a mutual correlation range, the mutual correlation range being between ±0.9;
c) determines a performance value of a combination of the at least two candidate biomarkers; and,
d) defines a diagnostic signature in accordance with the combination of the at least two biomarkers if the performance value is greater than or equal to a performance threshold representing the ability of the indicator to diagnose the presence, absence, degree or prognosis of the at least one condition, the performance threshold being indicative of an explained variance of at least 0.3.

In another broad form the present invention seeks to provide a method for diagnosing the presence or absence of inSIRS or a healthy condition in a biological subject, the method comprising: (a) determining a plurality of IRS biomarker values, each IRS biomarker value being indicative of a value measured or derived for at least one IRS biomarker of a biological subject; (b) determining the indicator using a combination of the plurality of IRS biomarker values, the at least one indicator being at least partially indicative of the presence, absence, degree or prognosis of the at least one condition selected from inSIRS and a healthy condition, wherein: (i) at least two IRS biomarkers have a mutual correlation in respect of the at least one condition that lies within a mutual correlation range, the mutual correlation range being between ±0.9; and (ii) the indicator has a performance value greater than or equal to a performance threshold representing the ability of the indicator to diagnose the presence, absence or degree of the at least one condition, or to provide a prognosis for the at least one condition, the performance threshold being indicative of an explained variance of at least 0.3, wherein at least one of the at least two IRS biomarkers is selected from a first IRS biomarker group and wherein at least one other of the at least two IRS biomarkers is selected from a second IRS biomarker group, wherein the first IRS biomarker group consists of polynucleotide and/or polypeptide expression products from group A IRS biomarker genes and wherein the second IRS biomarker group consists of polynucleotide and/or polypeptide expression products from group B IRS biomarker genes.

In another broad form the present invention seeks to provide a method for diagnosing the presence or absence of ipSIRS or a healthy condition in a biological subject, the method comprising: (a) determining a plurality of IRS biomarker values, each IRS biomarker value being indicative of a value measured or derived for at least one IRS biomarker of a biological subject; (b) determining the indicator using a combination of the plurality of IRS biomarker values, the at least one indicator being at least partially indicative of the presence, absence, degree or prognosis of the at least one condition selected from ipSIRS and a healthy condition, wherein: (i) at least two IRS biomarkers have a mutual correlation in respect of the at least one condition that lies within a mutual correlation range, the mutual correlation range being between ±0.9; and (ii) the indicator has a performance value greater than or equal to a performance threshold representing the ability of the indicator to diagnose the presence, absence or degree of the at least one condition, or to provide a prognosis for the at least one condition, the performance threshold being indicative of an explained variance of at least 0.3, wherein at least one of the at least two IRS biomarkers is selected from a first IRS biomarker group and wherein at least one other of the at least two IRS biomarkers is selected from a second IRS biomarker group, wherein the first IRS biomarker group consists of polynucleotide and/or polypeptide expression products from group C IRS biomarker genes and wherein the second IRS biomarker group consists of polynucleotide and/or polypeptide expression products from group D IRS biomarker genes.

In another broad form the present invention seeks to provide a method for diagnosing the presence or absence of inSIRS or ipSIRS in a biological subject, the method comprising: (a) determining a plurality of IRS biomarker values, each IRS biomarker value being indicative of a value measured or derived for at least one IRS biomarker of a biological subject; (b) determining the indicator using a combination of the plurality of IRS biomarker values, the at least one indicator being at least partially indicative of the presence, absence, degree or prognosis of the at least one condition selected from inSIRS and ipSIRS, wherein: (i) at least two IRS biomarkers have a mutual correlation in respect of the at least one condition that lies within a mutual correlation range, the mutual correlation range being between ±0.9; and (ii) the indicator has a performance value greater than or equal to a performance threshold representing the ability of the indicator to diagnose the presence, absence or degree of the at least one condition, or to provide a prognosis for the at least one condition, the performance threshold being indicative of an explained variance of at least 0.3, wherein at least one of the at least two IRS biomarkers is selected from a first IRS biomarker group and wherein at least one other of the at least two IRS biomarkers is selected from a second IRS biomarker group, wherein the first IRS biomarker group consists of polynucleotide and/or polypeptide expression products from group E IRS biomarker genes and wherein the second IRS biomarker group consists of polynucleotide and/or polypeptide expression products from group F IRS biomarker genes.

In another broad form the present invention seeks to provide a method for diagnosing the presence or absence of inSIRS or ipSIRS in a biological subject, the method comprising: (a) determining a plurality of IRS biomarker values, each IRS biomarker value being indicative of a value measured or derived for at least one IRS biomarker of a biological subject; (b) determining the indicator using a combination of the plurality of IRS biomarker values, the at least one indicator being at least partially indicative of the presence, absence, degree or prognosis of the at least one condition selected from inSIRS and ipSIRS, wherein: (i) at least four IRS biomarkers have a mutual correlation in respect of the at least one condition that lies within a mutual correlation range, the mutual correlation range being between ±0.9; and (ii) the indicator has a performance value greater than or equal to a performance threshold representing the ability of the indicator to diagnose the presence, absence or degree of the at least one condition, or to provide a prognosis for the at least one condition, the performance threshold being indicative of an explained variance of at least 0.3, wherein at least one of the at least four IRS biomarkers is selected from a first IRS biomarker group, wherein at least one other of the at least four IRS biomarkers is selected from a second IRS biomarker group, wherein at least one other of the at least four IRS biomarkers is selected from a third IRS biomarker group, and wherein at least one other of the at least four IRS biomarkers is selected from a fourth IRS biomarker group, wherein the first IRS biomarker group consists of polynucleotide and/or polypeptide expression products from group G IRS biomarker genes, wherein the second IRS biomarker group consists of polynucleotide and/or polypeptide expression products from group H IRS biomarker genes, wherein the third IRS biomarker group consists of polynucleotide and/or polypeptide expression products from group I IRS biomarker genes and wherein the fourth IRS biomarker group consists of polynucleotide and/or polypeptide expression products from group J IRS biomarker genes.

Suitably, the first IRS biomarker is a PLA2G7 expression product, the second IRS biomarker is a PLAC8 expression product, the third IRS biomarker is a CEACAM4 expression product and the fourth IRS biomarker is a LAMP1 expression product.

In another broad form the present invention seeks to provide a method for diagnosing the presence or absence of mild sepsis or severe sepsis in a biological subject, the method comprising: (a) determining a plurality of IRS biomarker values, each IRS biomarker value being indicative of a value measured or derived for at least one IRS biomarker of a biological subject; (b) determining the indicator using a combination of the plurality of IRS biomarker values, the at least one indicator being at least partially indicative of the presence, absence, degree or prognosis of the at least one condition selected from mild sepsis and severe sepsis, wherein: (i) at least two IRS biomarkers have a mutual correlation in respect of the at least one condition that lies within a mutual correlation range, the mutual correlation range being between ±0.9; and (ii) the indicator has a performance value greater than or equal to a performance threshold representing the ability of the indicator to diagnose the presence, absence or degree of the at least one condition, or to provide a prognosis for the at least one condition, the performance threshold being indicative of an explained variance of at least 0.3, wherein at least one of the at least two IRS biomarkers is selected from a first IRS biomarker group and wherein at least one other of the at least two IRS biomarkers is selected from a second IRS biomarker group, wherein the first IRS biomarker group consists of polynucleotide and/or polypeptide expression products from group K IRS biomarker genes and wherein the second IRS biomarker group consists of polynucleotide and/or polypeptide expression products from group L IRS biomarker genes.

In another form the present invention seeks to provide a method for diagnosing the presence or absence of mild sepsis or septic shock in a biological subject, the method comprising: (a) determining a plurality of IRS biomarker values, each IRS biomarker value being indicative of a value measured or derived for at least one IRS biomarker of a biological subject; (b) determining the indicator using a combination of the plurality of IRS biomarker values, the at least one indicator being at least partially indicative of the presence, absence, degree or prognosis of the at least one condition selected from mild sepsis and septic shock, wherein: (i) at least two IRS biomarkers have a mutual correlation in respect of the at least one condition that lies within a mutual correlation range, the mutual correlation range being between ±0.9; and (ii) the indicator has a performance value greater than or equal to a performance threshold representing the ability of the indicator to diagnose the presence, absence or degree of the at least one condition, or to provide a prognosis for the at least one condition, the performance threshold being indicative of an explained variance of at least 0.3, wherein at least one of the at least two IRS biomarkers is selected from a first IRS biomarker group and wherein at least one other of the at least two IRS biomarkers is selected from a second IRS biomarker group, wherein the first IRS biomarker group consists of polynucleotide and/or polypeptide expression products from group M IRS biomarker genes and wherein the second IRS biomarker group consists of polynucleotide and/or polypeptide expression products from group N IRS biomarker genes.

In another form the present invention seeks to provide a method for diagnosing the presence or absence of severe sepsis or septic shock in a biological subject, the method comprising: (a) determining a plurality of IRS biomarker values, each IRS biomarker value being indicative of a value measured or derived for at least one IRS biomarker of a biological subject; (b) determining the indicator using a combination of the plurality of IRS biomarker values, the at least one indicator being at least partially indicative of the presence, absence, degree or prognosis of the at least one condition selected from severe sepsis and septic shock, wherein: (i) at least two IRS biomarkers have a mutual correlation in respect of the at least one condition that lies within a mutual correlation range, the mutual correlation range being between ±0.9; and (ii) the indicator has a performance value greater than or equal to a performance threshold representing the ability of the indicator to diagnose the presence, absence or degree of the at least one condition, or to provide a prognosis for the at least one condition, the performance threshold being indicative of an explained variance of at least 0.3, wherein at least one of the at least two IRS biomarkers is selected from a first IRS biomarker group and wherein at least one other of the at least two IRS biomarkers is selected from a second IRS biomarker group, wherein the first IRS biomarker group consists of polynucleotide and/or polypeptide expression products from group O IRS biomarker genes and wherein the second IRS biomarker group consists of polynucleotide and/or polypeptide expression products from group P IRS biomarker genes.

In another broad form the present invention seeks to provide a kit comprising: (i) a reagent that allows quantification of a first IRS biomarker; and (ii) a reagent that allows quantification of a second IRS biomarker, wherein the first and second IRS biomarkers have a mutual correlation in respect of at least one condition selected from a healthy condition, inSIRS, ipSIRS or a stage of ipSIRS selected from mild sepsis, severe sepsis and septic shock, which at least one condition lies within a mutual correlation range of between ±0.9, and wherein a combination of respective biomarker values for the first and second IRS biomarkers that are measured for or derived from a biological subject has a performance value greater than or equal to a performance threshold representing the ability of the combination of the first and second IRS biomarkers to diagnose the presence, absence or degree of the at least one condition, or to provide a prognosis for the at least one condition, the performance threshold being a variance explained of at least 0.3.

Suitably, the kit further comprises: (iii) a reagent that allows quantification of a third IRS biomarker; and (iv) a reagent that allows quantification of a fourth IRS biomarker, wherein the third and fourth IRS biomarkers have a mutual correlation in respect of at the least one condition that lies within a mutual correlation range of between ±0.9, and wherein a combination of respective biomarker values for the third and fourth IRS biomarkers that are measured for or derived from a biological subject has a performance value greater than or equal to a performance threshold representing the ability of the combination of the third and fourth IRS biomarkers to diagnose the presence, absence or degree of the at least one condition, or to provide a prognosis for the at least one condition, the performance threshold being a variance explained of at least 0.3.

Suitably, the kit is for diagnosing the presence or absence of inSIRS or a healthy condition, wherein the first IRS biomarker is selected from a first IRS biomarker group and wherein the second IRS biomarker is selected from a second IRS biomarker group, wherein the first IRS biomarker group consists of polynucleotide and/or polypeptide expression products from group A IRS biomarker genes and wherein the second IRS biomarker group consists of polynucleotide and/or polypeptide expression products from group B IRS biomarker genes.

Suitably, the kit is for diagnosing the presence or absence of ipSIRS or a healthy condition, wherein the first IRS biomarker is selected from a first IRS biomarker group and wherein the second IRS biomarker is selected from a second IRS biomarker group, wherein the first IRS biomarker group consists of polynucleotide and/or polypeptide expression products from group C IRS biomarker genes and wherein the second IRS biomarker group consists of polynucleotide and/or polypeptide expression products from group D IRS biomarker genes.

Suitably, the kit is for diagnosing the presence or absence of inSIRS or ipSIRS, wherein the first IRS biomarker is selected from a first IRS biomarker group and wherein the second IRS biomarker is selected from a second IRS biomarker group, wherein the first IRS biomarker group consists of polynucleotide and/or polypeptide expression products from group E IRS biomarker genes and wherein the second IRS biomarker group consists of polynucleotide and/or polypeptide expression products from group F IRS biomarker genes.

Suitably, the kit is for diagnosing the presence or absence of inSIRS or ipSIRS, wherein the first IRS biomarker is selected from a first IRS biomarker group, wherein the second IRS biomarker is selected from a second IRS biomarker group, wherein the third IRS biomarker is selected from a third IRS biomarker group and wherein the fourth IRS biomarker is selected from a fourth IRS biomarker group, wherein the first IRS biomarker group consists of polynucleotide and/or polypeptide expression products from group G IRS biomarker genes, wherein the second IRS biomarker group consists of polynucleotide and/or polypeptide expression products from group H IRS biomarker genes, wherein the third IRS biomarker group consists of polynucleotide and/or polypeptide expression products from group I IRS biomarker genes and wherein the fourth IRS biomarker group consists of polynucleotide and/or polypeptide expression products from group J IRS biomarker genes.

Suitably, the first IRS biomarker is a PLA2G7 expression product, the second IRS biomarker is a PLAC8 expression product, the third IRS biomarker is a CEACAM4 expression product and the fourth IRS biomarker is a LAMP1 expression product.

Suitably, the kit is for diagnosing the presence or absence of mild sepsis or severe sepsis, wherein the first IRS biomarker is selected from a first IRS biomarker group and wherein the second IRS biomarker is selected from a second IRS biomarker group, wherein the first IRS biomarker group consists of polynucleotide and/or polypeptide expression products from group K IRS biomarker genes and wherein the second IRS biomarker group consists of polynucleotide and/or polypeptide expression products from group L IRS biomarker genes.

Suitably, the kit is for diagnosing the presence or absence of mild sepsis or septic shock, wherein the first IRS biomarker is selected from a first IRS biomarker group and wherein the second IRS biomarker is selected from a second IRS biomarker group, wherein the first IRS biomarker group consists of polynucleotide and/or polypeptide expression products from group M IRS biomarker genes and wherein the second IRS biomarker group consists of polynucleotide and/or polypeptide expression products from group N IRS biomarker genes.

Suitably, the kit is for diagnosing the presence or absence of severe sepsis or septic shock, wherein the first IRS biomarker is selected from a first IRS biomarker group and wherein the second IRS biomarker is selected from a second IRS biomarker group, wherein the first IRS biomarker group consists of polynucleotide and/or polypeptide expression products from group O IRS biomarker genes and wherein the second IRS biomarker group consists of polynucleotide and/or polypeptide expression products from group P IRS biomarker genes.

In another broad form the present invention seeks to provide a method for treating, preventing or inhibiting the development of at least one condition selected from inSIRS, ipSIRS or a particular stage of ipSIRS (e.g., mild sepsis, severe sepsis or septic shock) in a subject, the method comprising (a) determining a plurality of IRS biomarker values, each IRS biomarker value being indicative of a value measured or derived for at least one IRS biomarker of a biological subject; (b) determining an indicator using a combination of the plurality of IRS biomarker values, the indicator being at least partially indicative of the presence, absence or degree of the at least one condition, wherein: (i) at least two IRS biomarkers have a mutual correlation in respect of the at least one condition that lies within a mutual correlation range, the mutual correlation range being between ±0.9; and (ii) the indicator has a performance value greater than or equal to a performance threshold representing the ability of the indicator to diagnose the presence, absence or degree of the at least one condition, the performance threshold being indicative of an explained variance of at least 0.3; and (c) administering to the subject, on the basis that the indicator indicates the presence of inSIRS, an effective amount of an agent that treats or ameliorates the symptoms or reverses or inhibits the development of inSIRS, or administering to the subject, on the basis that the indicator indicates the presence of ipSIRS or a particular stage of ipSIRS, an effective amount of an agent that treats or ameliorates the symptoms or reverses or inhibits the development of ipSIRS or the particular stage of ipSIRS.

Suitably, the method further comprises: (1) determining a plurality of measured IRS biomarker values, each measured IRS biomarker value being a measured value of an IRS biomarker of the biological subject; and (2) applying a function to at least one of the measured IRS biomarker values to determine at least one derived IRS biomarker value, the at least one derived IRS biomarker value being indicative of a value of a corresponding derived IRS biomarker.

Suitably, the function includes at least one of: (a) multiplying two IRS biomarker values; (b) dividing two IRS biomarker values; (c) adding two IRS biomarker values; (d) subtracting two IRS biomarker values; (e) a weighted sum of at least two IRS biomarker values; (f) a log sum of at least two IRS biomarker values; and (g) a sigmoidal function of at least two IRS biomarker values.

In another broad form the present invention seeks to provide a method of monitoring the efficacy of a particular treatment regimen in a subject towards a desired health state, the method comprising: a) determining a plurality of IRS biomarker values, each IRS biomarker value being indicative of a value measured or derived for at least one IRS biomarker of a biological subject after treatment with a treatment regimen; (b) determining an indicator using a combination of the plurality of IRS biomarker values, the indicator being at least partially indicative of the presence, absence or degree of at least one condition selected from a healthy condition, inSIRS, ipSIRS or a particular stage of ipSIRS, wherein: (i) at least two IRS biomarkers have a mutual correlation in respect of the at least one condition that lies within a mutual correlation range, the mutual correlation range being between ±0.9; and (ii) the indicator has a performance value greater than or equal to a performance threshold representing the ability of the indicator to diagnose the presence, absence or degree of the at least one condition, or to provide a prognosis for the at least one condition, the performance threshold being indicative of an explained variance of at least 0.3, and (c) determining that the treatment regimen is effective for changing the health status of the subject to the desired health state on the basis that the indicator indicates the presence of a healthy condition or the presence of a condition of a lower degree relative to the degree of the condition in the subject before treatment with the treatment regimen.

In another broad form the present invention seeks to provide a method of correlating a biomarker signature with an effective treatment regimen for a condition selected from inSIRS, ipSIRS or a particular stage of ipSIRS (e.g., mild sepsis, severe sepsis and septic shock), the method comprising: (a) determining a biomarker signature defining a combination of at least two IRS biomarker values corresponding to values of at least two IRS biomarkers that can be measured for or derived from a biological subject having the condition and for whom an effective treatment has been identified, wherein: (i) the at least two IRS biomarkers have a mutual correlation in respect of the condition that lies within a mutual correlation range, the mutual correlation range being between ±0.9; and (ii) the combination of at least two biomarker values has a performance value greater than or equal to a performance threshold representing the ability of the combination of at least two biomarker values to diagnose the presence, absence or degree of the condition, or to provide a prognosis for the condition, the performance threshold being indicative of an explained variance of at least 0.3; and (b) correlating the biomarker signature so determined with an effective treatment regimen for the condition.

In another broad form the present invention seeks to provide a method of determining whether a treatment regimen is effective for treating a subject with a condition selected from inSIRS, ipSIRS or a particular stage of ipSIRS (e.g., mild sepsis, severe sepsis and septic shock), the method comprising: (a) determining a plurality of post-treatment IRS biomarker values, each post-treatment IRS biomarker value being indicative of a value measured or derived for at least one IRS biomarker of a biological subject after treatment with the treatment regimen; (b) determining a post-treatment indicator using a combination of the plurality of post-treatment IRS biomarker values, the post-treatment indicator being at least partially indicative of the presence, absence or degree of at least one condition selected from a healthy condition, inSIRS, ipSIRS or a particular stage of ipSIRS, wherein: (i) at the least two IRS biomarkers have a mutual correlation in respect of the at least one condition that lies within a mutual correlation range, the mutual correlation range being between ±0.9; and (ii) the post-treatment indicator has a performance value greater than or equal to a performance threshold representing the ability of the post-treatment indicator to diagnose the presence, absence or degree of the at least one condition, the performance threshold being indicative of an explained variance of at least 0.3, wherein the post-treatment indicator indicates whether the treatment regimen is effective for treating the condition in the subject on the basis that post-treatment indicator indicates the presence of a healthy condition or the presence of a condition of a lower degree relative to the degree of the condition in the subject before treatment with the treatment regimen.

In another broad form the present invention seeks to provide a method of correlating a biomarker signature with a positive or negative response or a side effect to a treatment regimen, the method comprising: (a) determining a biomarker signature defining a combination of at least two IRS biomarker values corresponding to values of at least two IRS biomarkers that can be measured for or derived from a biological subject following commencement of the treatment regimen, wherein: (i) the at least two IRS biomarkers have a mutual correlation in respect of at least one condition selected from a healthy condition, inSIRS, ipSIRS or a particular stage of ipSIRS (e.g., mild sepsis, severe sepsis and septic shock), which lies within a mutual correlation range, the mutual correlation range being between ±0.9; and (ii) the combination of at least two biomarker values has a performance value greater than or equal to a performance threshold representing the ability of the combination of at least two biomarker values to diagnose the presence, absence or degree of the at least one condition, or to provide a prognosis for the at least one condition, the performance threshold being indicative of an explained variance of at least 0.3; and (b) correlating the biomarker signature so determined with a positive or negative response to the treatment regimen.

In another broad form the present invention seeks to provide a method of determining a positive or negative response to a treatment regimen and/or a side effect of a treatment regimen by a subject with a condition selected from inSIRS, ipSIRS or a particular stage of ipSIRS (e.g., mild sepsis, severe sepsis and septic shock), the method: (a) correlating a reference biomarker signature with a positive or negative response or a side effect to the treatment regimen, wherein the biomarker signature defines a combination of at least two IRS biomarker values corresponding to values of at least two IRS biomarkers that are measured for or derived from a control biological subject or control group, wherein: (i) the at least two IRS biomarkers have a mutual correlation in respect of at least one condition selected from a healthy condition, inSIRS, ipSIRS or a particular stage of ipSIRS (e.g., mild sepsis, severe sepsis and septic shock), which lies within a mutual correlation range, the mutual correlation range being between ±0.9; and (ii) the combination of at least two biomarker values has a performance value greater than or equal to a performance threshold representing the ability of the combination of at least two biomarker values to diagnose the presence, absence or degree of the at least one condition, or to provide a prognosis for the at least one condition, the performance threshold being indicative of an explained variance of at least 0.3; (b) determining a sample biomarker signature defining a combination of at least two IRS biomarker values corresponding to values of at least two IRS biomarkers that are measured for or derived from a biological subject following commencement of the treatment regimen, wherein: (i) the at least two IRS biomarkers have a mutual correlation in respect of at least one condition selected from a healthy condition, inSIRS, ipSIRS or a particular stage of ipSIRS, which lies within a mutual correlation range, the mutual correlation range being between ±0.9; and (ii) the combination of at least two biomarker values has a performance value greater than or equal to a performance threshold representing the ability of the combination of at least two biomarker values to diagnose the presence, absence or degree of the at least one condition, or to provide a prognosis for the at least one condition, the performance threshold being indicative of an explained variance of at least 0.3; wherein the sample biomarker signature indicates whether the subject is responding positively or negatively to the treatment regimen and/or is developing a side effect from the treatment regimen, based on the correlation of the reference biomarker signature with the positive or negative response or side effect to the treatment regimen.

In another broad form the present invention seeks to provide a method of determining a positive or negative response to a treatment regimen and/or a side effect to a treatment regimen by a biological subject, the method comprising: (a) determining a sample biomarker signature defining a combination of at least two IRS biomarker values corresponding to values of at least two IRS biomarkers that are measured for or derived from a biological subject following commencement of the treatment regimen, wherein: (i) the at least two IRS biomarkers have a mutual correlation in respect of at least one condition selected from a healthy condition, inSIRS, ipSIRS or a particular stage of ipSIRS (e.g., mild sepsis, severe sepsis and septic shock), which lies within a mutual correlation range, the mutual correlation range being between ±0.9; and (ii) the combination of at least two biomarker values has a performance value greater than or equal to a performance threshold representing the ability of the combination of at least two biomarker values to diagnose the presence, absence or degree of the at least one condition, or to provide a prognosis for the at least one condition, the performance threshold being indicative of an explained variance of at least 0.3, wherein the sample biomarker signature is correlated with a positive or negative response to the treatment regimen and/or to a side effect from the treatment regimen; and (b) determining whether the subject is responding positively or negatively to the treatment regimen and/or is developing a side effect from the treatment regimen based on the sample biomarker signature.

BRIEF DESCRIPTION OF THE DRAWINGS

An example of the present invention will now be described with reference to the accompanying drawings, in which: —

FIG. 8A is a plot of 941 mRNA biomarkers against the AUC for differentiating between healthy condition and post-surgical inflammation (PS) (also referred to herein as "infection-negative SIRS" (inSIRS)), for individual biomarkers having an AUC greater than 0.7;

FIG. 8B is a box and whisker plot showing the best mRNA biomarker for separating healthy condition and PS;

FIG. 8C is a plot of the AUC for the diagnostic ability of 1000 derived biomarkers in separating healthy condition and PS with all derived biomarkers having an AUC of 1.0;

FIG. 8D is a box and whisker plot of the best performing derived biomarker, based on AUC, for separating healthy condition and PS;

FIGS. 8E and 8F are two plots showing the correlation to each other of the biomarkers in each group;

FIGS. 8G and 8H are two plots demonstrating the AUC of the biomarkers in each group (groups 1 and 2);

FIG. 8I is a box and whisker plot showing that when biomarkers are derived from group 1 and group 2 that a greater overall AUC is obtained;

FIG. 10A is a plot of the 359 mRNA biomarkers against the AUC for differentiating between PS and sepsis with all individual biomarkers having had an AUC greater than 0.7;

FIG. 10B is a box and whisker plot showing the best mRNA biomarker for separating PS and sepsis;

FIG. 10C is a plot of the AUC for the diagnostic ability of 1000 derived biomarkers in separating PS and sepsis with all derived biomarkers having an AUC of 0.9;

FIG. 10D is a box and whisker plot of the best derived biomarker for separating PS and sepsis;

FIG. 10E is a plot showing the correlation of the biomarkers in each bucketgroup to the condition;

FIG. 11A is a plot of the 66 mRNA biomarkers against the AUC for differentiating between mild sepsis and severe sepsis with all individual biomarkers selected having an AUC greater than 0.7;

FIG. 11B is a box and whisker plot showing the best mRNA biomarker for separating mild sepsis and severe sepsis;

FIG. 11C is a plot of the AUC for the diagnostic ability of 1000 derived biomarkers in separating mild sepsis and severe sepsis with all derived biomarkers have an AUC of at least 0.87;

FIG. 11D is a box and whisker plot of the best performing derived biomarker, based on AUC, for separating mild sepsis and severe sepsis;

FIGS. 11E and 11F are plots showing the correlation to each other of the biomarkers in each group;

FIGS. 11G and 11H are plots demonstrating the AUC of the biomarkers in each group;

FIGS. 13G and 13H are plots demonstrating the AUC of the biomarkers in each group;

FIG. 13I is a box and whisker plot showing that when biomarkers are derived from group 1 and group 2 that a greater overall AUC is obtained;

FIGS. 17A to 17L are box and whisker plots for the top twelve biomarker combinations for distinguishing between healthy condition and sepsis;

DETAILED DESCRIPTION OF THE PREFERRED EMBODIMENTS

Figure 1A:
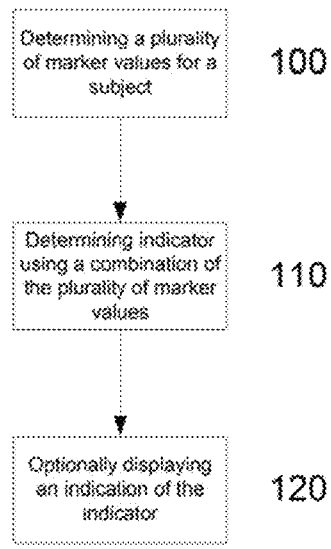
FIG. 1A is a flowchart of an example of a method for deriving an indicator for use in diagnosing the presence, absence or degree of at least one condition or in providing a prognosis of at least one condition in a biological subject.

An example of a method for determining an indicator for use in diagnosing the presence, absence or degree of at least one condition in or of a biological subject, or in monitoring the progression of at least one condition in or of the subject, or in prognosing at least one condition in or of the subject, will now be described with reference to FIG. 1A.

For the purpose of explanation, a number of different terms will be used. For example, the term "biomarker" refers to a measurable parameter, or combination of parameters, that can be used as an indicator of a biological state and includes, without limitation, proteins, nucleic acids, carbohydrates, lipids, metabolites, gases, steroids, ions, nutrients, toxins, cells, pathogenic organisms, non-pathogenic organisms, organic compounds and inorganic compounds. Biomarkers also encompass non-blood-borne factors, non-analyte physiological markers of health status, or other factors or biomarkers not measured from samples (e.g., biological samples such as bodily fluids), such as "clinical" or "phenotypic" parameters, including, without limitation, age, ethnicity, gender, species, breed, genetic information, white blood cell count, diastolic blood pressure and systolic blood pressure, bone density, height, weight, waist and hip circumference, body-mass index, as well as others such as Type I or Type II diabetes mellitus or gestational diabetes mellitus (collectively referred to here as diabetes), resting heart rate, homeostatic model assessment (HOMA), HOMA insulin resistance (HOMA-IR), intravenous glucose tolerance (SI (IVGT)), resting heart rate, β cell function, macrovascular function, microvascular function, atherogenic index, low-density lipoprotein/high-density lipoprotein ratio, intima-media thickness, body temperature, sequential organ failure assessment (SOFA) and the like. The "biomarkers" could also include "immune response biomarkers", which will be described in more detail below.

The term "biomarker value" refers to a value measured or derived for at least one corresponding biomarker of the biological subject and which is typically at least partially indicative of a concentration of the immune system biomarker in a sample taken from the subject. Thus, the biomarker values could be measured biomarker values, which are values of biomarkers measured for the subject, or alternatively could be derived biomarker values, which are values that have been derived from one or more measured biomarker values, for example by applying a function to the one or more measured biomarker values.

Biomarker values can be of any appropriate form depending on the manner in which the values are determined. For example, the biomarker values could be determined using high-throughput technologies such as mass spectrometry, sequencing platforms, array and hybridization platforms, immunoassays, flow cytometry, or any combination of such technologies and in one preferred example, the biomarker values relate to a level of activity or abundance of an expression product or other measurable molecule, quantified using a technique such as PCR, sequencing or the like. In this case, the biomarker values can be in the form of amplification amounts, or cycle times, which are a logarithmic representation of the concentration of the biomarker within a sample, as will be appreciated by persons skilled in the art and as will be described in more detail below.

The term "reference biomarkers" is used to refer to biomarkers whose activity has been quantified for a sample population of one or more individuals having one or more conditions, stages of one or more conditions, subtypes of one or more conditions or different prognoses. The term "reference data" refers to data measured for one or more individuals in a sample population, and may include quantification of the level or activity of the biomarkers measured for each individual, information regarding any conditions of the individuals, and optionally any other information of interest.

The term "candidate biomarkers" refers to a subset of the reference biomarkers that have been identified as being potentially useful in distinguishing between different groups of individuals, such as individuals suffering from different conditions, or having different stages or prognoses. The number of candidate biomarkers will vary, but is typically about 200.

The term "signature biomarkers" is used to refer to a subset of the candidate biomarkers that have been identified for use in a biomarker signature that can be used in performing a clinical assessment, such as to rule in or rule out a specific condition, different stages or severity of conditions, subtypes of different conditions or different prognoses. The number of signature biomarkers will vary, but is typically of the order of 10 or less.

The term "biomarker signature" means a combination of at least two biomarker values corresponding to values of biomarkers that can be measured for or derived from one or more biological subjects, which combination is characteristic for a discrete condition, stage of condition, subtype of condition or a prognosis for a discrete condition, stage of condition, subtype of condition.

The terms "biological subject", "subject", "individual" and "patient" are used interchangeably herein to refer to an animal subject, particularly a vertebrate subject, and even more particularly a mammalian subject. Suitable vertebrate animals that fall within the scope of the invention include, but are not restricted to, any member of the phylum Chordata, subphylum vertebrata including primates, rodents (e.g., mice rats, guinea pigs), lagomorphs (e.g., rabbits, hares), bovines (e.g., cattle), ovines (e.g., sheep), caprines (e.g., goats), porcines (e.g., pigs), equines (e.g., horses), canines (e.g., dogs), felines (e.g., cats), avians (e.g., chickens, turkeys, ducks, geese, companion birds such as canaries, budgerigars etc.), marine mammals (e.g., dolphins, whales), reptiles (snakes, frogs, lizards, etc.), and fish. A preferred subject is a primate (e.g., a human, ape, monkey, chimpanzee).

As used herein, the term SIRS ("systemic inflammatory response syndrome") refers to a clinical response arising from a non-specific insult with two or more of the following measurable clinical characteristics; a body temperature greater than 38° C. or less than 36° C., a heart rate greater than 90 beats per minute, a respiratory rate greater than 20 per minute, a white blood cell count (total leukocytes) greater than 12,000 per $mm^3$ or less than 4,000 per $mm^3$, or a band neutrophil percentage greater than 10%. From an immunological perspective, it may be seen as representing a systemic response to insult (e.g., major surgery) or systemic inflammation. As used herein, "inSIRS" (which includes within its scope "post-surgical" (PS) inflammation) includes the clinical response noted above but in the absence of a systemic infectious process. By contrast, "ipSIRS" (also referred to herein as "sepsis") includes the clinical response noted above but in the presence of a presumed or confirmed infection. Confirmation of infection can be determined using microbiological culture or isolation of the infectious agent. From an immunological perspective, ipSIRS may be seen as a systemic response to microorganisms, whether it is a local, peripheral or systemic infection.

As used herein, the term "degree" of a condition refers to the seriousness, severity, stage or state of a condition. For example, a condition may be characterized as mild, moderate or severe. A person of skill in the art would be able to determine or assess the degree of a particular condition. For example, the degree of a condition may be determined by comparing the likelihood or length of survival of a subject having a condition with the likelihood or length of survival in other subjects having the same condition. In other embodiments, the degree of a condition may be determined by comparing the clinical signs of a subject having a condition with the degree of the clinical signs in other subjects having the same condition.

It will be appreciated that the above described terms and associated definitions are used for the purpose of explanation only and are not intended to be limiting.

In this example, the method includes determining a plurality of biomarker values at step 100, each biomarker value being indicative of a value measured or derived for at least one biomarker of the biological subject.

The biomarker values and biomarkers corresponding to the biomarker values can be of any appropriate form and in particular can relate to any attribute of a subject for which a value can be quantified. This technique is particularly suited to high-throughput technologies such as mass spectrometry, sequencing platforms, array and hybridization platforms, or any combination of such technologies and in one preferred example, the biomarker values relate to a level of activity or abundance of an expression product or other measurable molecule.

The biomarker values could be measured biomarker values, which are values of biomarkers measured for the subject, or alternatively could be derived biomarker values, which are values that have been derived from one or more measured biomarker values, for example by applying a function to the one or more measured biomarker values. As used herein, biomarkers to which a function has been applied are referred to as "derived markers".

The biomarker values may be determined in any one of a number of ways. In one example, the process of determining the biomarker values can include measuring the biomarker values, for example by performing tests on the biological subject. More typically however, the step of determining the biomarker values includes having an electronic processing device receive or otherwise obtain biomarker values that have been previously measured or derived. This could include for example, retrieving the biomarker values from a data store such as a remote database, obtaining biomarker values that have been manually input, using an input device, or the like.

At step 110, the indicator is determined using a combination of the plurality of biomarker values, the indicator being at least partially indicative of the presence, absence, degree or prognosis of the at least one condition.

The biomarker values can be combined in any one of a number of ways and this can include for example adding, multiplying, subtracting, or dividing biomarker values to determine an indicator value. This step is performed so that multiple biomarker values can be combined into a single indicator value, providing a more useful and straightforward mechanism for allowing the indicator to be interpreted and hence used in diagnosing the presence, absence or degree of the at least one condition in the subject, or prognosing the at least one condition in the subject.

Assuming the method is performed using an electronic processing device, at step 120 an indication of the indicator is optionally displayed or otherwise provided to the user. In this regard, the indication could be a graphical or alphanumeric representation of an indicator value. Alternatively however, the indication could be the result of a comparison of the indicator value to predefined thresholds or ranges, or alternatively could be an indication of the presence, absence, degree or prognosis for at least one condition, derived using the indicator.

In order to ensure an effective diagnosis or prognosis can be determined, at least two of the biomarkers have a mutual correlation in respect of the at least one condition that lies within a mutual correlation range, the mutual correlation range being between ±0.9. This requirement means that the two biomarkers are not entirely correlated in respect of each other when considered in the context of the condition(s) being diagnosed or prognosed. In other words, at least two of the biomarkers in the combination respond differently as the condition changes, which adds significantly to their ability when combined to discriminate between at least two conditions, to diagnose the presence, absence or degree of at least one condition, and/or to provide a prognosis of at least condition in or of the biological subject. As used herein, "and/or" refers to and encompasses any and all possible combinations of one or more of the associated listed items, as well as the lack of combinations when interpreted in the alternative (or).

Typically, the requirement that biomarkers have a low mutual correlation means that the biomarkers may relate to different biological attributes or domains such as but not limited to different molecular functions, different biological processes and different cellular components. Illustrative examples of molecular function include addition of or removal of one of more of the following moieties to or from a protein, polypeptide, peptide, nucleic acid (e.g., DNA, RNA): linear, branched, saturated or unsaturated alkyl (e.g., $C_1$-$C_{24}$ alkyl); phosphate; ubiquitin; acyl; fatty acid, lipid, phospholipid; nucleotide base; hydroxyl and the like. Molecular functions also include signaling pathways, including without limitation, receptor signaling pathways and nuclear signaling pathways. Non-limiting examples of molecular functions also include cleavage of a nucleic acid, peptide, polypeptide or protein at one or more sites; polymerization of a nucleic acid, peptide, polypeptide or protein; translocation through a cell membrane (e.g., outer cell membrane; nuclear membrane); translocation into or out of a cell organelle (e.g., Golgi apparatus, lysosome, endoplasmic reticulum, nucleus, mitochondria); receptor binding, receptor signaling, membrane channel binding, membrane channel influx or efflux; and the like.

Illustrative examples of biological processes include: stages of the cell cycle such as meiosis, mitosis, cell division, prophase, metaphase, anaphase, telophase and interphase, stages of cell differentiation; apoptosis; necrosis; chemotaxis; immune responses including adaptive and innate immune responses, pro-inflammatory immune responses, autoimmune responses, tolerogenic responses and the like. Other illustrative examples of biological processes include generating or breaking down adenosine triphosphate (ATP), saccharides, polysaccharides, fatty acids, lipids, phospholipids, sphingolipids, glycolipids, cholesterol, nucleotides, nucleic acids, membranes (e.g., cell plasma membrane, nuclear membrane), amino acids, peptides, polypeptides, proteins and the like.

Representative examples of cellular components include organelles, membranes, as for example noted above, and others.

It will be appreciated that the use of biomarkers that have different biological attributes or domains provides further information than if the biomarkers were related to the same or common biological attributes or domains.

In this regard, it will be appreciated if the at least two biomarkers are highly correlated to each other, the use of both biomarkers would add little diagnostic/prognostic improvement compared to the use of a single one of the biomarkers. Accordingly, the method uses biomarkers that are not well correlated with each other, thereby ensuring that the inclusion of each biomarker in the method adds significantly to the discriminative ability of the indicator.

Despite this, in order to ensure that the indicator can accurately be used in performing the discrimination between at least two conditions or the diagnosis of the presence, absence or degree of at least one condition or the prognosis of at least one condition, the indicator has a performance value that is greater than or equal to a performance threshold. The performance threshold may be of any suitable form but is to be typically indicative of an explained variance of at least 0.3, or an equivalent value of another performance measure.

It has been found that utilizing a combination of biomarkers that have a mutual correlation between ±0.9 and using these in a combination that provides an explained variance of at least 0.3, this allows an indicator to be defined that is suitable for ensuring that an accurate discrimination, diagnosis or prognosis can be obtained whilst minimizing the number of biomarkers that are required.

It will be appreciated that in this context, the biomarkers used within the above-described method can define a biomarker signature for the at least one condition, which includes a minimal number of biomarkers, whilst maintaining sufficient performance to allow the biomarker signature to be used in making a clinically relevant diagnosis, prognosis, or differentiation. Minimizing the number of biomarkers used minimizes the costs associated with performing diagnostic or prognostic tests and in the case of nucleic acid expression products, allows the test to be performed utilizing relatively straightforward techniques such as nucleic acid array, and polymerase chain reaction (PCR) processes, or the like, allowing the test to be performed rapidly in a clinical environment.

Furthermore, producing a single indicator value allows the results of the test to be easily interpreted by a clinician or other medical practitioner, so that test can be used for reliable diagnosis in a clinical environment.

An example of the process for generating a suitable biomarker signature for use in the method of FIG. 1A will now be described with reference to FIG. 1B.

In particular, it is typical to generate a biomarker signature by analyzing a large number of biomarkers and then selecting a combination of biomarkers that meet the above described criteria.

In this example, at step 150 the process includes ranking a number of candidate biomarkers in accordance with the ability of each biomarker to distinguish between the presence, absence, degree or prognosis of at least one condition in a biological subject.

The candidate biomarkers can be obtained in any appropriate matter, but typically this would involve acquiring reference data including reference biomarker values relating to a number of reference biomarkers that have been measured or derived for one or more reference individuals having different presences, absences, degrees or prognoses of the one or more conditions of interest. Thus, it will be appreciated that the candidate biomarkers can include measured and/or derived biomarkers, as will be described in more detail below.

The reference data typically includes measurements of a plurality of reference biomarkers, the measurements including information regarding the activity, such as the level, abundance or functional activity, of any expression product or measurable molecule, as will be described in more detail below. The reference data may also include information such as clinical data regarding one or more conditions suffered by each individual. This can include information regarding a presence, absence, degree or progression of a condition, phenotypic information, such as details of phenotypic traits, genetic or genetically regulated information, amino acid or nucleotide related genomics information, results of other tests including imaging, biochemical and hematological assays, other physiological scores such as a SOFA (Sequential Organ Failure Assessment) score, or the like and this is not intended to be limiting, as will be apparent from the description below.

The candidate biomarkers can include some or all of the reference biomarkers, depending on the preferred implementation. Thus, for example, reference biomarker values could be analyzed to determine correlations between the reference biomarkers and the at least one condition, with the reference biomarkers being coarsely filtered to remove those with a low correlation, for example with a correlation with the condition that is below 0.3.

At step 160 at least two candidate biomarkers are selected based on the ranking and a mutual correlation. In particular, at least two candidate biomarkers are selected which have a mutual correlation within a mutual correlation range of ±0.9. Thus, this process excludes any biomarkers which are highly mutually correlated, when considered in the context of the one or more conditions, and which would not therefore add significantly to the ability to discriminate between the presence, absence, degree or prognosis of at least one condition.

At step 170 a performance value of a combination of the selected candidate biomarkers is determined. As mentioned above the combination may be any combination of the candidate biomarker values, such as addition, subtraction, multiplication, or division of the candidate biomarker values, and this will not therefore be described in any further detail.

At step 180 it is determined if the performance value of the combination exceeds a performance threshold, the performance threshold being equivalent to an explained variance of at least 0.3. If so, the combination of the candidate biomarkers can be used to define a biomarker signature. Otherwise, the previous steps can be repeated, for example by determining alternative combinations of the candidate biomarkers, selecting different candidate biomarkers, or adding additional candidate biomarkers as will be described in more detail below. In this regard, it will be appreciated that other measures could be used, and reference to an explained variance of at least 0.3 is intended to be a particular example for illustrative purposes.

Figure 1B:
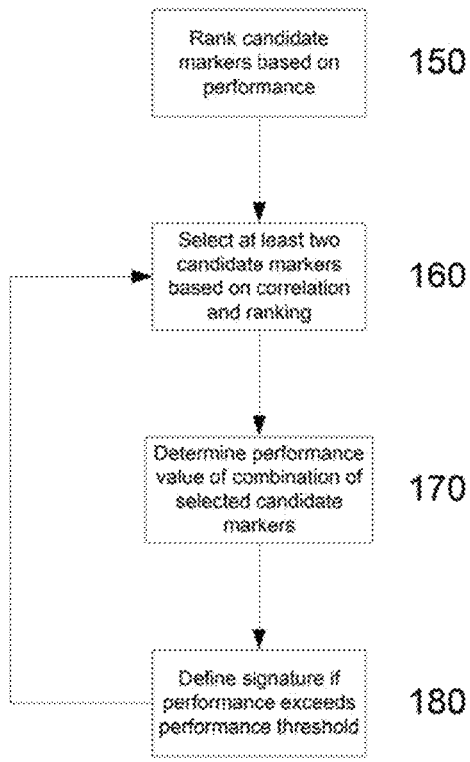
FIG. 1B is a flowchart of an example of a method for identifying biomarkers for use in a biomarker signature.

Accordingly, the above described method can be utilized to select a combination of candidate biomarkers that are suitable for use as signature biomarkers in a biomarker signature for diagnosing the presence, absence, degree or prognosis of at least one condition in a biological subject, for example using the method of FIG. 1A above.

In one example, this is achieved by ensuring that at least two of the biomarkers used are not highly mutually correlated, thereby ensuring that each of these biomarkers contributes to the performance of the resulting signature.

A number of further features will now be described.

In one example, the method includes determining a plurality of measured biomarker values, each measured biomarker value being a measured value of a corresponding biomarker of the biological subject and applying a function to at least one of the measured biomarker values to determine at least one derived biomarker value, the at least one derived biomarker value being indicative of a value of a corresponding derived biomarker.

The function used will therefore vary depending on the preferred implementation. In one example, the function includes at least one of multiplying two biomarker values; dividing two biomarker values; adding two biomarker values; subtracting two biomarker values; a weighted sum of at least two biomarker values; a log sum of at least two biomarker values; and, a sigmoidal function of at least two biomarker values.

More typically the function is division of two biomarker values, so that the derived biomarker value corresponds to a ratio of two measured biomarker values. There are a number of reasons why the ratio might be preferred. For example, use of a ratio is self-normalizing, meaning variations in measuring techniques will automatically be accommodated. For example, if the input concentration of a sample is doubled, the relative proportions of biomarkers will remain the same. As a result, the type of function therefore has a stable profile over a range of input concentrations, which is important because input concentration is a known variable for expression data. Additionally, many biomarkers are nodes on biochemical pathways, so the ratio of biomarkers gives information about the relative activation of one biological pathway to another, which is a natural representation of biological change within a system. Finally, ratios are typically easily interpreted.

The method typically includes combining at least two biomarker values to determine an indicator value representing the indicator. This is usually achieved by combining at least two biomarker values using a combining function, such as: an additive model; a linear model; a support vector machine; a neural network model; a random forest model; a regression model; a genetic algorithm; an annealing algorithm; and a weighted sum.

In one example, at least one of the at least two biomarkers is a derived biomarker and in a preferred example, the combining function is addition of derived biomarker values that are ratios, in which case the method includes determining first and second derived biomarker values from ratios of first and second and third and fourth measured biomarker values, and then adding the first and second derived biomarker values to generate an indicator value.

In one example, the method includes determining an indicator value, comparing the indicator value to at least one indicator value range, and using a result of the comparison in diagnosing the presence, absence, degree or prognosis of at least one condition.

The above-described process is typically performed using an electronic processing device, forming part of a processing system such as a computer system or the like. In this case, the method typically involves having the electronic processing device receive a plurality of measured biomarker values, apply a function to at least one of the measured biomarker values to determine the at least one derived biomarker value and combining at least one derived biomarker value and at least one other biomarker value to determine an indicator value.

The electronic processing device can then generate a representation in accordance with the at least one indicator value, for example by displaying a numerical indication of the indicator value. More typically however the electronic processing device compares the indicator value to at least one indicator value range and displays a result of the comparison. This can be used to compare the indicator to defined ranges representing specific stages, progressions or prognoses of one or more conditions, allowing an indication of the respective stage, progression or prognosis to be displayed.

The mutual correlation range is typically at least one of: ±0.8; ±0.7; ±0.6; ±0.5; ±0.4; ±0.3; ±0.2; and ±0.1. In this regard, it will be appreciated that the smaller the mutual correlation range used, the less correlated the biomarkers will be and hence the more useful these will be in discriminating between the specific stages, progressions or prognoses of one or more conditions.

It is also typical for the biomarkers used to have at least a minimum correlation with the condition. In one example, each biomarker has a condition correlation with the presence, absence, degree or prognosis of the at least one condition that lies outside a condition correlation range, the condition correlation range being between ±0.3. However, it will be appreciated that the greater the range, the greater the correlation between the biomarker and condition, and hence the more use this will be in performing a diagnosis. Accordingly, the condition correlation is more typically one of: ±0.9; ±0.8; ±0.7; ±0.6; ±0.5; and ±0.4.

Furthermore, it will be appreciated that the greater the performance of the indicator, the greater use the indicator will be in performing the diagnosis. Accordingly, the performance threshold is typically indicative of an explained variance of at least one of: 0.4; 0.5; 0.6; 0.7; 0.8; and 0.9.

As described above, the biomarker value can be of any suitable form. However, the technique is particularly suited to biomarker values indicative of a level or abundance of a molecule selected from one or more of: a nucleic acid molecule; a proteinaceous molecule; an amino acid; a carbohydrate; a lipid; a steroid; an inorganic molecule; an ion; a drug; a chemical; a metabolite; a toxin; a nutrient; a gas; a cell; a pathogenic organism; and a non-pathogenic organism.

When determining biomarkers for use in a biomarker signature, the method typically includes selecting a combining function, determining if a performance value of a combination of the at least two candidate biomarkers determined by the combining function is greater than or equal to a performance threshold and if the performance value is not greater than or equal to a performance threshold, repeating these steps for successive different combining functions. Thus, this allows a number of different combining functions to be tried successively, allowing the best combining function to be identified.

The method typically further includes selecting two candidate biomarkers, determining if a performance value of a combination of the two candidate biomarkers is greater than or equal to a performance threshold and if not, combining the selected candidate biomarkers with at least one additional candidate biomarker before repeating the steps with at least one additional candidate biomarker. This allows a larger number of biomarkers to be used in the event two biomarkers are insufficient, and this can be repeated, with increasing numbers of candidate biomarkers used in combination and compared to the performance threshold until the required performance is reached, or up until a defined number limit of candidate biomarkers is reached.

To ensure the required mutual correlation is met when selecting the candidate biomarkers, the method typically includes selecting a highest and a next highest ranked candidate biomarker, for the selected candidate biomarkers, determining if the mutual correlation for the candidate biomarkers within the mutual correlation range and if not repeating these steps until two candidate biomarkers are selected having a mutual correlation within the mutual correlation range. Alternatively however this can be achieved by defining at least two groups of candidate biomarkers, candidate biomarkers in different groups having a mutual correlation within the mutual correlation range, ranking the candidate biomarkers in each group and selecting candidate biomarkers from the different groups.

In general, the candidate biomarkers are determined by using reference data for at least one individual to define a number of groups indicative of the presence, absence, degree or prognosis of the at least one condition and then using at least one analysis technique to identify a number of candidate biomarkers that are potentially useful for distinguishing the groups. The groups can also be used to establish a range of at least two reference biomarker values to determine an indicator value range for the group.

In one example, reference values measured for reference biomarkers for the at least one individual can then be used to identify the candidate biomarkers, for example by filtering reference biomarkers to determine candidate biomarkers based on a correlation of each biomarker with the condition.

Figure 2:
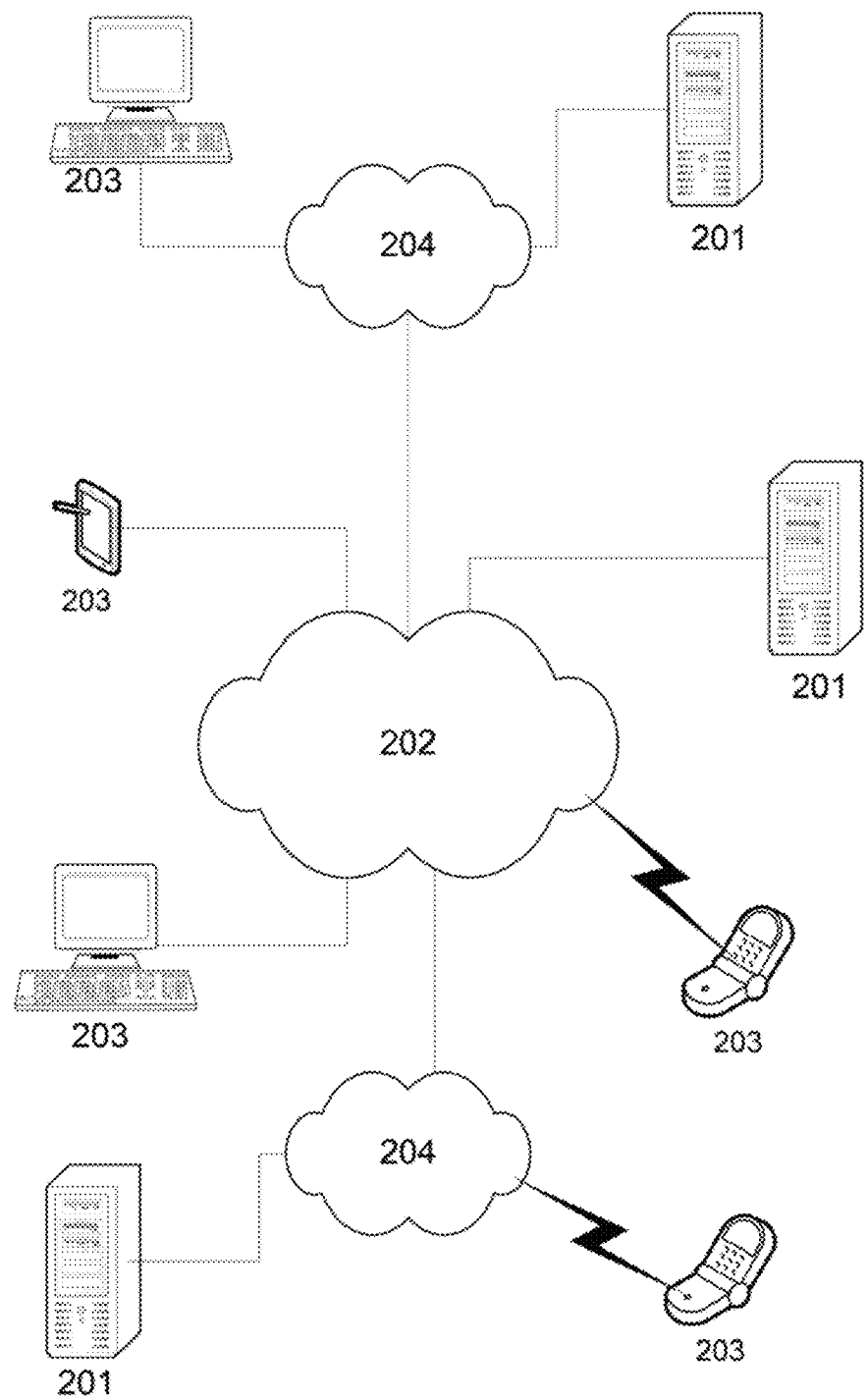
FIG. 2 is a schematic diagram of an example of a distributed computer architecture.

In one example, the process is performed by one or more processing systems operating as part of a distributed architecture, an example of which will now be described with reference to FIG. 2.

In this example, the arrangement includes a number of processing systems 201 and computer systems 203 interconnected via one or more communications networks, such as the Internet 202, and/or a number of local area networks (LANs) 204. It will be appreciated that the configuration of the networks 202, 204 is for the purpose of example only, and in practice the processing and computer systems 201, 203 can communicate via any appropriate mechanism, such as via wired or wireless connections, including, but not limited to mobile networks, private networks, such as an 802.11 networks, the Internet, LANs, WANs, or the like, as well as via direct or point-to-point connections, such as Bluetooth, or the like.

The use of separate terms "processing system" and "computer system" is for illustrative purposes and to enable distinction between different devices, optionally having different functionality. For example, the processing and computer systems 201, 203 could represent servers and clients respectively, as will become apparent from the following description. However, this is not intended to be limiting and in practice any suitable computer network architecture can be used.

Figure 3:
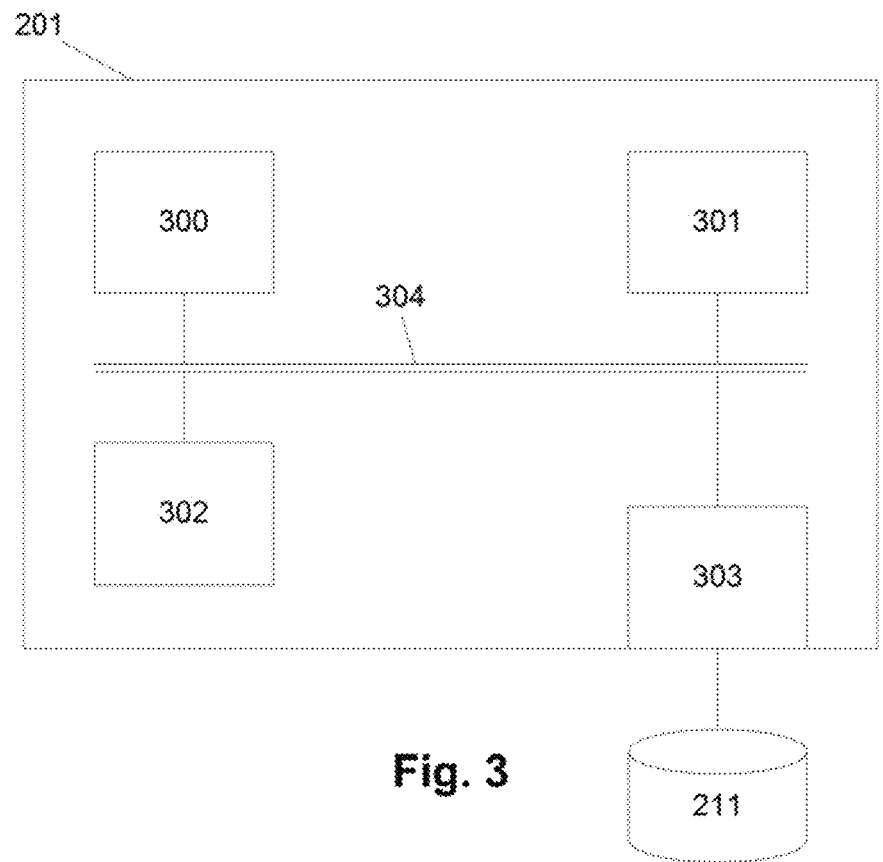
FIG. 3 is a schematic diagram of an example of a processing system of FIG. 2.

An example of a suitable processing system 201 is shown in FIG. 3. In this example, the processing system 201 includes an electronic processing device, such as at least one microprocessor 300, a memory 301, an optional input/output device 302, such as a keyboard and/or display, and an external interface 303, interconnected via a bus 304 as shown. In this example the external interface 303 can be utilized for connecting the processing system 201 to peripheral devices, such as the communications networks 202, 204, databases 211, other storage devices, or the like. Although a single external interface 303 is shown, this is for the purpose of example only, and in practice multiple interfaces using various methods (e.g., Ethernet, serial, USB, wireless or the like) may be provided.

In use, the microprocessor 300 executes instructions in the form of applications software stored in the memory 301 to perform required processes, such as communicating with other processing or computer systems 201, 203. Thus, actions performed by a processing system 201 are performed by the processor 300 in accordance with instructions stored as applications software in the memory 301 and/or input commands received via the I/O device 302, or commands received from other processing or computer systems 201, 203. The applications software may include one or more software modules, and may be executed in a suitable execution environment, such as an operating system environment, or the like.

Accordingly, it will be appreciated that the processing systems 201 may be formed from any suitable processing system, such as a suitably programmed computer system, PC, web server, network server, or the like. In one particular example, the processing systems 201 are standard processing system such as a 32-bit or 64-bit Intel Architecture based processing system, which executes software applications stored on non-volatile (e.g., hard disk) storage, although this is not essential. However, it will also be understood that the processing system could be or could include any electronic processing device such as a microprocessor, microchip processor, logic gate configuration, firmware optionally associated with implementing logic such as an FPGA (Field Programmable Gate Array), or any other electronic device, system or arrangement.

Figure 4:
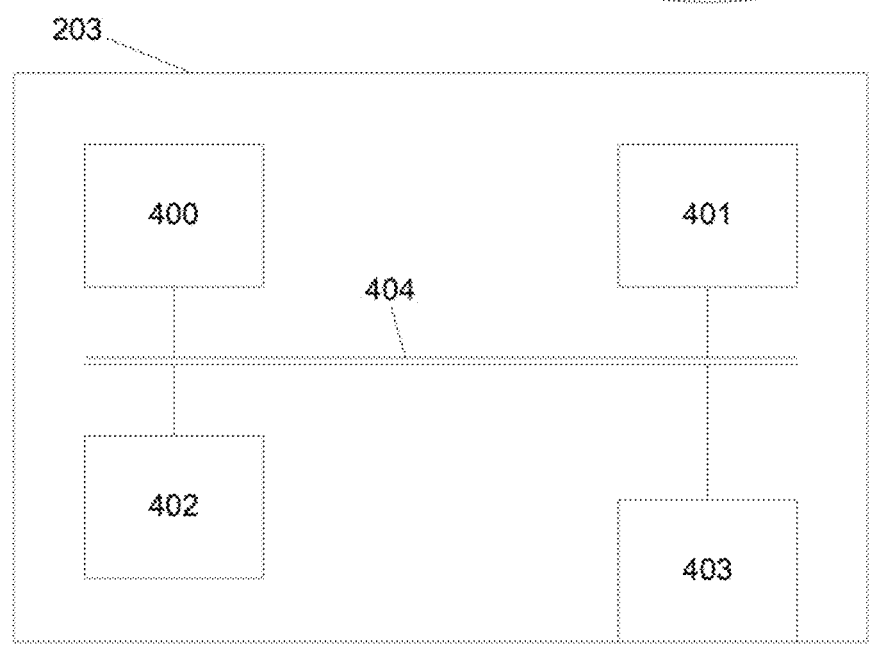
FIG. 4 is a schematic diagram of an example of a computer system of FIG. 2.

As shown in FIG. 4, in one example, the computer systems 203 include an electronic processing device, such as at least one microprocessor 400, a memory 401, an input/output device 402, such as a keyboard and/or display, and an external interface 403, interconnected via a bus 404 as shown. In this example the external interface 403 can be utilized for connecting the computer system 203 to peripheral devices, such as the communications networks 202, 204, databases, other storage devices, or the like. Although a single external interface 403 is shown, this is for the purpose of example only, and in practice multiple interfaces using various methods (e.g., Ethernet, serial, USB, wireless or the like) may be provided.

In use, the microprocessor 400 executes instructions in the form of applications software stored in the memory 401 to perform required processes, for example to allow communication with other processing or computer systems 201, 203. Thus, actions performed by a processing system 203 are performed by the processor 400 in accordance with instructions stored as applications software in the memory 401 and/or input commands received from a user via the I/O device 402. The applications software may include one or more software modules, and may be executed in a suitable execution environment, such as an operating system environment, or the like.

Accordingly, it will be appreciated that the computer systems 203 may be formed from any suitable processing system, such as a suitably programmed PC, Internet terminal, lap-top, hand-held PC, smart phone, PDA, tablet, or the like. Thus, in one example, the processing system 300 is a standard processing system such as a 32-bit or 64-bit Intel Architecture based processing system, which executes software applications stored on non-volatile (e.g., hard disk) storage, although this is not essential. However, it will also be understood that the processing systems 203 can be any electronic processing device such as a microprocessor, microchip processor, logic gate configuration, firmware optionally associated with implementing logic such as an FPGA (Field Programmable Gate Array), or any other electronic device, system or arrangement.

It will also be noted that whilst the processing and computer systems 201, 203 are shown as single entities, it will be appreciated that this is not essential, and instead one or more of the processing and/or computer systems 201, 203 can be distributed over geographically separate locations, for example by using processing systems provided as part of a cloud based environment.

Examples of the above-described method(s) will now be described in further detail. For the purpose of these examples, it is assumed that the process is performed by one or more of the processing systems 201, acting as diagnostic servers. Interaction by a user is via a user computer system 203, which is used to allow a user to submit raw data, for example obtained from measurements on a subject, with the processing system 201 generating the indicator, allowing this to be displayed on the computer system 203.

However, it will be appreciated that the above-described configuration assumed for the purpose of the following examples is not essential, and numerous other configurations may be used. It will also be appreciated that the partitioning of functionality between the processing and computer systems 201, 203 may vary, depending on the particular implementation.

Figure 5:
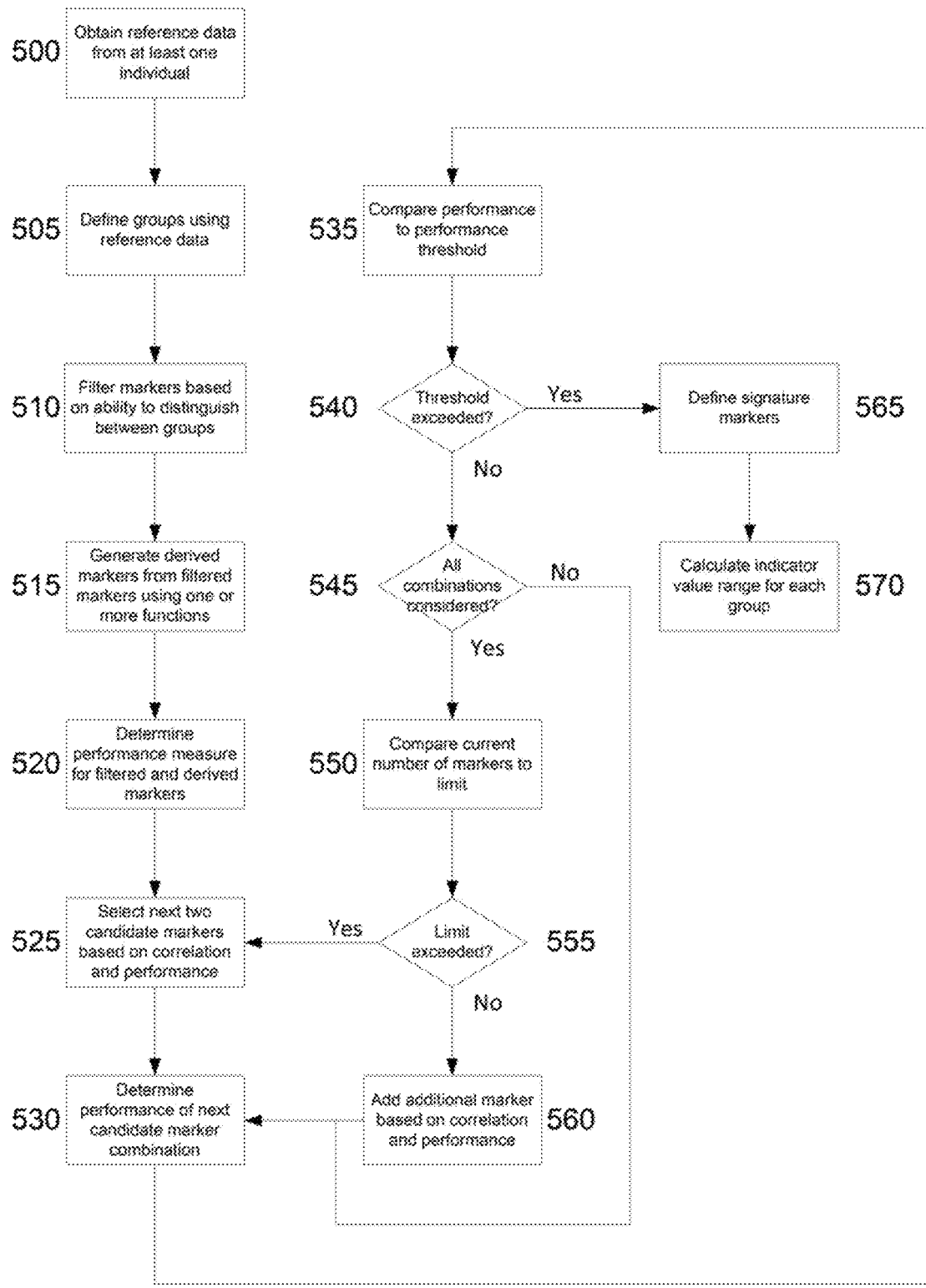
FIG. 5 is a flowchart of a specific example of a method for identifying biomarkers for use in a biomarker signature.

An example of a specific method for identifying biomarkers for using a biomarker signature will now be described with reference to FIG. 5.

In this example, at step 500 reference data is obtained from at least one individual. The reference data is typically in the form of measured biomarker values obtained for at least one individual for different stages of the at least one condition.

The reference data may be acquired in any appropriate manner but typically this involves obtaining gene expression product data from a plurality of individuals, selected to include individuals diagnosed with one or more conditions of interest, as well as healthy individuals. Detection of either types of gene expression in use of any of the methods described herein is encompassed by the present invention. The terms "expression" or "gene expression" refer to production of RNA only or production of RNA and translation of RNA into proteins or polypeptides. Thus, the term "expression products" encompass (i) polynucleotides including RNA transcripts and corresponding nucleic acids including complementary cDNA copies of RNA transcripts, and (ii) polypeptides encoded by RNA transcripts. The conditions are typically medical, veterinary or other health status conditions and may include any illness, disease, stages of disease, disease subtypes, severities of disease, diseases of varying prognoses or the like. The terms "healthy individual", "healthy subject" and the like are used herein to refer to a subject, in particular a mammal, having no diagnosed disease, disorder, infirmity, or ailment. The condition of such an individual or subject is referred to herein as a "healthy condition" such that in one example a condition can include healthy. In specific embodiments, a healthy subject lacks SIRS (e.g., inSIRS or ipSIRS).

In order to achieve this, gene expression product data are collected, for example by obtaining a biological sample, such as a peripheral blood sample, and then performing a quantification process, such as a nucleic acid amplification process, including PCR (Polymerase Chain Reaction) or the like, in order to assess the activity, and in particular, level or abundance of a number of reference biomarkers. Quantified values indicative of the relative activity are then stored as part of the reference data.

Example reference biomarkers could include expression products such as nucleic acid or proteinaceous molecules, as well as other molecules relevant in making a clinical assessment. The number of biomarkers measured for use as reference biomarkers will vary depending upon the preferred implementation, but typically include a large number such as, 1000, 5000, 10000 or above, although this is not intended to be limiting.

The individuals also typically undergo a clinical assessment allowing any conditions to be clinically identified, and with an indication of any assessment or condition forming part of the reference data. Whilst any conditions can be assessed, in one example the process is utilized specifically to identify conditions such as SIRS (Systemic Inflammatory Response Syndrome) (M S Rangel-Frausto, D Pittet, M Costigan, T Hwang, C S Davis, and R P Wenzel, "The Natural History of the Systemic Inflammatory Response Syndrome (SIRS). a Prospective Study.", *JAMA: the Journal of the American Medical Association* 273, no. 2 (Jan. 11, 1995): 117-123.). SIRS is an overwhelming whole body reaction that may have an infectious or non-infectious etiology, whereas sepsis is SIRS that occurs during infection. Both are defined by a number of non-specific host response parameters including changes in heart and respiratory rate, body temperature and white cell counts (Mitchell M Levy et al., "2001 SCCM/ESICM/ACCP/ATS/SIS International Sepsis Definitions Conference", *Critical Care Medicine* 31, no. 4 (April 2003): 1250-1256.; K Reinhart, M Bauer, N C Riedemann, and C S Hartog, "New Approaches to Sepsis: Molecular Diagnostics and Biomarkers", *Clinical Microbiology Reviews* 25, no. 4 (Oct. 3, 2012): 609-634) To differentiate these conditions they are referred herein to as SIRS (both conditions), infection-negative SIRS (SIRS without infection, hereafter referred to as "inSIRS") and infection-positive SIRS (sepsis, SIRS with a known or suspected infection, hereafter referred to as "ipSIRS") The causes of SIRS are multiple and varied and can include, but are not limited to, trauma, burns, pancreatitis, endotoxemia, surgery, adverse drug reactions, and infections (local and systemic). It will be appreciated from the following, however, that this can be applied to a range of different conditions, and reference to SIRS or sepsis is not intended to be limiting.

Additionally, the reference data may include additional biomarkers such as one or more phenotypic or clinical parameters of the individuals and/or their relatives. Phenotypic parameters can include information such as the gender, ethnicity, age, hair color, eye color, height, weight, waist and hip circumference, or the like. Also, in the case of the technology being applied to individuals other than humans, this can also include information such as designation of a species, breed or the like. Clinical traits may include genetic information, white blood cell count, diastolic blood pressure and systolic blood pressure, bone density, body-mass index, diabetes, resting heart rate, HOMA, HOMA-IR, IVGT, resting heart rate, β cell function, macrovascular function, microvascular function, atherogenic index, low-density lipoprotein/high-density lipoprotein ratio, intima-media thickness, body temperature, SOFA and the like.

Accordingly, in one example the reference data can include for each of the reference individuals information relating to at least one and desirably to a plurality of reference biomarkers and a presence, absence, degree or progression of a condition.

The reference data may be collected from individuals presenting at a medical center with clinical signs relating to relevant any conditions of interest, and may involve follow-on consultations in order to confirm clinical assessments, as well as to identify changes in biomarkers, and/or clinical signs, and/or severity of clinical signs, over a period of time. In this latter case, the reference data can include time series data indicative of the progression of a condition, and/or the activity of the reference biomarkers, so that the reference data for an individual can be used to determine if the condition of the individual is improving, worsening or static. It will also be appreciated that the reference biomarkers are preferably substantially similar for the individuals within the sample population, so that comparisons of measured activities between individuals can be made.

This reference data could also be collected from a single individual over time, for example as a condition within the individual progresses, although more typically it would be obtained from multiple individuals each of which has a different stage of the one or more conditions of interest.

It will be appreciated that once collected, the reference data can be stored in the database 211 allowing this to be subsequently retrieved by the processing system 201 for subsequent analysis. The processing system 201 also typically stores an indication of an identity of each of the reference biomarkers.

In one example, the measurements are received as raw data, which then undergoes preliminary processing. Such raw data corresponds to information that has come from a source without modification, such as outputs from instruments such as PCR machines, array (e.g., microarray) scanners, sequencing machines, clinical notes or any other biochemical, biological, observational data, or the like. This step can be used to convert the raw data into a format that is better suited to analysis. In one example this is performed in order to normalize the raw data and thereby assist in ensuring the biomarker values demonstrate consistency even when measured using different techniques, different equipment, or the like. Thus, the goal of normalization is to remove the variation within the samples that is not directly attributable to the specific analysis under consideration. For example, to remove variances caused by differences in sample processing at different sites. Classic examples of normalization include z-score transformation for generic data, or popular domain specific normalizations, such as RMA normalization for microarrays.

However, it will also be appreciated that in some applications, such as a single sample experiment run on a single data acquisition machine, this step may not strictly be necessary, in which case the function can be a Null function producing an output identical to the input.

In one example, the preferred approach is a paired function approach over log normalized data. Log normalization is a standard data transformation on microarray data, because the data follow a log-normal distribution when coming off the machine. Applying a log transform turns the data into process-friendly normal data.

At step 505 different groups are defined using the reference data.

Prior to this occurring, the processing system 201 optionally removes a validation subgroup of individuals from the reference data to allow the processing system 201 to determine the candidate biomarkers using the reference data without the validation subgroup so that the validation subgroup can be subsequently used to validate the candidate biomarkers or signatures including a number of the candidate biomarkers. Thus, data from the validation subgroup is used to validate the efficacy of the candidate or signature biomarkers in identifying the presence, absence, degree, stage, severity, prognosis or progression of any one or more of the conditions to ensure the potential or signature biomarkers are effective.

In one example, this is achieved by having the processing system 201 flag individuals within the validation subgroup or alternatively store these in either an alternative location within the database 211 or an alternative database to the reference data. The validation subgroup of individuals is typically selected randomly and may optionally be selected to include individuals having different phenotypic traits. When a validation subgroup of individuals is removed, the remaining individuals will simply be referred to as reference data for ease throughout the remaining description.

The reference data (i.e., excluding the validation subgroup) are classified into groups. The groups may be defined in any appropriate manner and may be defined based on any one or more of an indication of a presence, absence, degree, stage, severity, prognosis or progression of a condition, other tests or assays, or measured biomarkers associated with the individuals.

For example, a first selection of groups may be to identify one or more groups of individuals suffering from SIRS, one or more groups of individuals suffering ipSIRS, one or more groups of individuals suffering inSIRS, and one or more groups of healthy individuals. Further groups may also be defined for individuals suffering from other conditions. The groups may include overlapping groups, so for example it may be desirable to define groups of healthy individuals and individuals having SIRS, with further being defined to distinguish inSIRS patients from ipSIRS patients, as well as different degree of inSIRS or ipSIRS, with these groups having SIRS in common, but each group of patients differing in whether a clinician has determined the presence of an infection or not. Additionally, further subdivision may be performed based on phenotypic traits, so groups could be defined based on gender, ethnicity or the like so that a plurality of groups of individuals suffering from a condition are defined, with each group relating to a different phenotypic trait.

It will also be appreciated, however, that identification of different groups can be performed in other manners, for example on the basis of particular activities of biomarkers within the biological samples of the reference individuals, and accordingly, reference to conditions is not intended to be limiting and other information may be used as required.

The manner in which classification into groups is performed may vary depending on the preferred implementation. In one example, this can be performed automatically by the processing system 201, for example, using unsupervised methods such as Principal Components Analysis (PCA), or supervised methods such as k-means or Self Organizing Map (SOM). Alternatively, this may be performed manually by an operator by allowing the operator to review reference data presented on a Graphical User Interface (GUI), and define respective groups using appropriate input commands.

At step 510 biomarkers are filtered based on their ability to distinguish between the groups. This process typically examines the activity of the reference biomarkers for individuals within and across the groups, to identify reference biomarkers whose activities differ between and hence can distinguish groups. A range of different analysis techniques can be utilized including, for example, regression or correlation analysis techniques. Examples of the techniques used can include established methods for parameterized model building such as Partial Least Squares, Random Forest or Support Vector Machines, usually coupled to a feature reduction technique for the selection of the specific subset of the biomarkers to be used in a signature.

Such techniques are known and described in a number of publications. For example, the use of Partial Least Squares is described in "Partial least squares: a versatile tool for the analysis of high-dimensional genomic data" by Boulesteix, Anne-Laure and Strimmer, Korbinian, from *Briefings in Bioinformatics* 2007 vol 8. no. 1, pg 32-44. Support Vector machines are described in "LIBSVM: a library for support vector machines" by Chang, C. C. and Lin, C. J. from ACM Transactions on Intelligent Systems and Technology (TIST), 2011 vol 2, no. 3, pg 27. Standard Random Forest in R language is described in "Classification and Regression by random Forest" by Liaw, A. and Wiener, M., in *R news* 2002, vol 2, no. 3, pg 18-22.

The analysis techniques are implemented by the processing system 201, using applications software, which allows the processing system 201 to perform multiple ones of the analysis techniques in sequence. This is advantageous as the different analysis techniques typically have different biases and can therefore be used to identify different potential biomarkers that can distinguish the groups, thereby reducing the risk of clinically relevant biomarkers being overlooked.

In one example, the process involves filtering out any biomarkers that demonstrate a correlation with the groups, and hence with the condition, that is below a certain correlation threshold, such as 0.3.

At step 515 derived biomarkers are generated from the filtered reference biomarkers using one or more functions. The nature of the derived biomarkers and the functions used will vary depending upon the preferred implementation. For example, functions can include division, subtraction, multiplication, addition of two markers, sigmoidal functions applied to the product of two biomarkers, negative logs of the division of two biomarkers, least-squares regression applied to two vectors of markers to produce a function (equation) output, concordance correlation coefficient of two vectors of categorical biomarkers, or the like.

In general, the function is selected based on a number of rules. These rules can include: utility, functions that provide the best results; interpretability, functions that can be understood in terms of biological function; output, functions that produce informative outputs; simplicity; performance assessment; least number of biomarkers for best performance; number of biomarkers at a statistical overfitting threshold or the like.

In one example, the preferred function is division, with the resulting biomarkers being different ratios. It will be appreciated that the division can be performed in multiple different ways, so that for three biomarkers, nine different derived biomarkers can be determined.

At step 520 a performance measure is determined for each of the candidate biomarkers, including the filtered reference biomarkers and any derived markers. The performance measure may be of any suitable form and typically includes a correlation or performance explained measure that is indicative of a correlation of the corresponding biomarker and its ability to distinguish between groups. In one example, the performance function used to determine the performance measure is a standard univariate statistical test over all candidate biomarkers. Other examples however include a t-test, a non-parametric equivalent or area under receiver operator curve, chi squared or regression analyses or their equivalents, extensions or derivatives may be used.

The outcome of the applying the performance function to each in the candidate selection step is a ranked list of biomarkers, with the top N ranked biomarkers proceeding to the next stage. The biomarkers falling below this threshold are no longer considered. The threshold applied may be an absolute number or proportion of all biomarkers, or determined by performance, such as a p value <0.05. The threshold should be chosen to contain a sufficiently large number of biomarkers to bias towards including sufficiently independent biomarkers (i.e., low mutual correlation).

At step 525, the processing system 201 selects a next two candidate biomarkers based on the performance measure and on a mutual correlation. In this regard, two markers that are highly correlated with each other in terms of the context of the condition will not necessarily improve the ability to distinguish a particular presence, absence, degree or prognosis of the condition any more than a single one of the markers. Accordingly, it is typical to select biomarkers that have a high performance measure in respect of the condition, but which have a mutual correlation that falls below a mutual correlation threshold. The mutual correlation threshold used will vary depending upon the preferred implementation, and is typically selected to be as low as possible, as described above. Examples of the manner in which the biomarkers are selected will be described in more detail below with respect to FIGS. 6A and 6B.

At step 530, the processing system 201 determines a performance of a next candidate biomarker combination. In this regard, the processing system 201 will use a combining function such as addition, to combine the biomarker values of the selected candidate biomarkers and use this to determine and indicator value based on the combination of biomarker values. The performance can be determined in any suitable manner, such as using statistical measurements, correlation measurements, concordance measurements or aggregate performance measurements such as averages. In one particular example, the performance measure is a 'variance explained' (VE). A VE of "1" means that using the biomarkers, you can perfectly classify/predict the disease. A VE of "0.8" means that your markers account for 80% of the result in practice.

Accordingly, at step 535 the processing system 201 compares the performance of the indicator to a performance threshold and determines if this is exceeded at step 540. In the event that the threshold is exceeded, this indicates that the selected combination of markers provides the required degree of discrimination allowing the presence, absence, degree or prognosis of the condition to be determined.

In the event that the threshold is not exceeded at step 540, it is determined if all combinations have been considered at step 545. In this regard, it is possible that multiple different combinations of the two selected biomarkers to be tried, so if each possible combination has not been considered, the processing system 201 returns to step 530 to determine the performance of a next candidate biomarker combination. In this regard, the combinations used will typically be ordered in terms of preference, so that preferred combinations are tried first, with less preferred combinations being tried only in the event that preferred combinations prove unsuccessful.

Once all candidate biomarker combinations have been considered for the two candidate biomarkers selected, and if the performance threshold has still not been exceeded, the process moves onto step 550 to compare the current number of candidate biomarkers being considered to a limit. In this regard, the limit is used to control the overall number of biomarkers in the biomarker signature, thereby minimizing signature size and hence the cost of performing the associated measurements and diagnosis.

If the limit has not been exceeded an additional biomarker is added based on the correlation and performance at step 560, with the process moving onto step 530 to determine a performance of the next candidate biomarker combination. Otherwise if a limit has been reached, then an alternative next two candidate biomarkers are selected at step 525. Thus, this process allows additional candidate biomarkers to be progressively included, with a combination of the multiple candidate biomarkers being compared to the performance threshold, to determine if the required performance is met. If this is not achieved before the number of candidate biomarkers reaches the limit, the process is recommenced using two different candidate biomarkers.

Once the performance threshold has been exceeded at step 540, the selected candidate biomarkers can be defined as signature biomarkers for inclusion in a biomarker signature for the one or more conditions at step 565.

It should be noted that before the biomarker signature is finalized at step 565, additional checks might be performed, to ensure that the candidate biomarkers included in the signature should not be excluded for any reason. For example, candidate biomarkers might be excluded for cost considerations as some combinations of candidate biomarkers may cost more than others. For example, a larger number of biomarkers may cost more than a smaller number, and the additional cost may not be justified by a small improvement in performance. Alternatively, the cost might be increased if multiple different tests are required in order to measure required biomarker values.

Biomarkers might also be excluded from use for legal reasons, for example if their use is restricted for approval or intellectual property reasons. Some biomarkers may be difficult to measure from a technical perspective, for example very low expression in vivo, which increases variability and therefore reduces robustness.

The performance of each biomarker combination panel may also include some variability, typically expressed as confidence intervals around the reported performance. Although a point estimate for one panel may be higher than for another, if the difference given the variability is not significant, the combinations may be considered equivalent.

Once a particular combination of signature biomarkers has been defined, at step 570 the processing system 201 can determine an indicator value range associated with each group. In particular, the range of reference biomarker values for the signature biomarkers within each group are used to calculate indicator value ranges for each group. These can then be compared to an indicator value calculated for a biological subject having an unknown presence absence, degree or progression of the at least one condition and used to identify a group to which the subject would belong and hence the presence, absence, degree or progression of the condition.

Thus, the above-described process iteratively assesses the biomarkers, initially selecting two biomarkers, with various combinations of these being considered to determine if these have the required performance for use in diagnosing the presence, absence, degree or progression of a condition. In the event that the required performance is not provided, additional biomarkers can be added and further combinations tried. Thus the process can consider three biomarkers, four biomarkers, five biomarkers, six biomarkers, seven biomarkers, eight biomarkers, nine biomarkers or more. Typically this is performed to a limit which may be defined based for example on the number of biomarkers that can practically be measured within given cost or process parameters. In the event that the required performance is not obtained the process moves onto to select alternative candidate biomarkers with this being repeated.

Thus it will be appreciated that the above process initially selects those biomarkers which have the suitable performance and which are not highly correlated on the basis that these provide the maximum performance. The ability of these biomarkers to distinguish is then tested and in the event that this is insufficient, further biomarkers can be added to a limit. If this still does not provide the required discriminatory performance alternative biomarkers can be selected.

The process of selecting two candidate biomarkers at step 525 can be achieved in any number of ways depending upon the preferred implementation and examples of this will now be described with reference to FIGS. 6A and 6B.

Figure 6A:
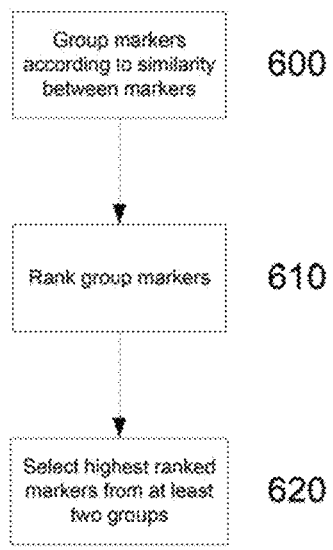
FIG. 6A is a flowchart of a first example of a method for selecting candidate biomarkers.

In the example of FIG. 6A, at step 600 biomarkers are grouped according to their mutual similarity. Thus, highly correlated biomarkers are put together in common groups. Biomarkers within the group are ranked at step 610 based on their performance measure in terms of their correlation with the condition, with the highest ranked biomarkers from two of the groups being selected at step 620 to define the next two candidate biomarkers. It will be appreciated if additional candidate biomarkers are required, these can be selected from different groups to the first two candidate biomarkers.

Figure 6B:
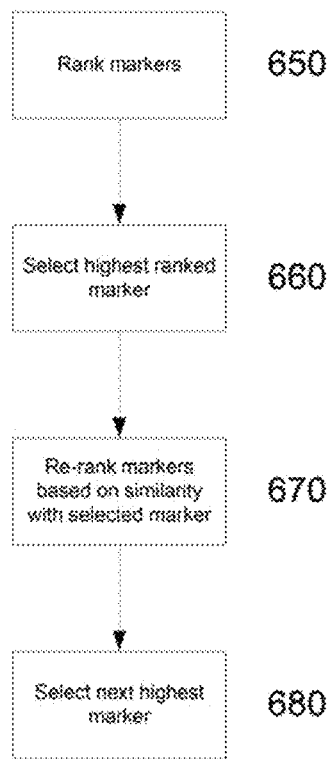
FIG. 6B is a flowchart of a second example of a method for selecting candidate biomarkers.

An alternative process is shown in FIG. 6B. In this example, at step 650 biomarkers are ranked based on their performance at discriminating the condition(s). At step 660 a next highest biomarker is selected, with the remaining biomarkers being re-ranked on the combination of their similarity with the selected biomarker, for example using mutual information, as well as their performance. The next highest biomarker is then selected at step 680 with this process being repeated as required.

Accordingly, it will be appreciated that the above-described processes provide mechanisms for selecting a combination of biomarkers, and more typically derived biomarkers, that can be used to form a biomarker signature, which in turn can be used in diagnosing the presence, absence or degree of at least one condition or in providing a prognosis of at least one condition. In this regard, the biomarker signature defines the biomarkers that should be measured (i.e., the signature biomarkers), how derived biomarker values should be determined for measured biomarker values, and then how biomarker values should be subsequently combined to generate an indicator value. The biomarker signature can also specify defined indicator value ranges that indicate a particular presence, absence, degree or prognosis of one or more conditions.

Figure 7:
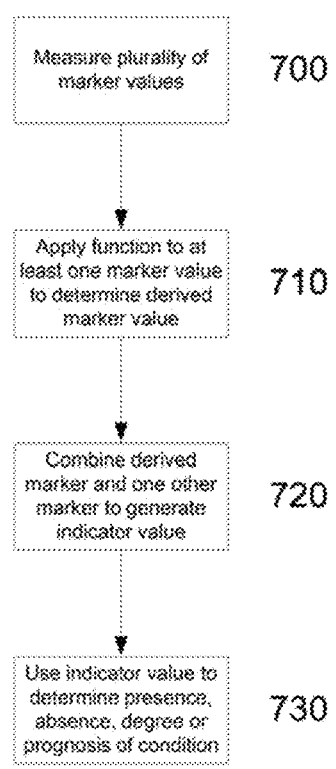
FIG. 7 is a flowchart of a second example of a method for use in diagnosing the presence, absence or degree of at least one condition or in providing a prognosis of at least one condition in a biological subject.

An example of the method of using a biomarker signature described above will now be described with reference to FIG. 7.

In this example, at step 700 a plurality of measured biomarker values are measured for a biological subject whose condition is unknown, with these typically being provided to the processing system 201, for example by download from measuring equipment or the like.

After any required processing, such as normalization or the like, at step 710, the processing system 201 applies one or more functions to the measured biomarker values to determine any required derived biomarker values. A derived biomarker value and another biomarker value (i.e., another derived biomarker value or a measured biomarker value) are combined to generate an indicator value, which can then be displayed or otherwise used in determining the presence, absence, degree or prognosis of one or more conditions. Thus, this can involve simply displaying the indicator value, allowing an assessment to be made by a medical practitioner or alternatively may involve further processing, such as comparing the indicator to defined indicator value ranges that indicate a particular presence, absence, degree or prognosis of one or more conditions, with the results of the comparison being displayed.

Accordingly, in the above-described method the biomarker signature defines the biomarker values that need to be measured and/or derived, allowing the processing system 201 to automatically generate an indicator value based on received measured biomarker values. Once this has been completed, the processing system 201 can compare the indicator value to the indicator value ranges, and either display results of the comparison, or alternative interpret the results of the comparison, allowing an indicator to be displayed that is indicative of the presence, absence, degree or prognosis of a condition. This can then be used by a medical practitioner as required in performing a medical diagnosis of the biological subject.

Using the above-described methods it has been identified that the use of ratios of "immune system biomarkers" is particularly beneficial when assessing a likelihood of a biological subject having a presence, absence, degree or prognosis of at least one medical condition.

As used herein, the term "immune system biomarker" refers to a biomarker of the host's immune system that is altered, or whose level of expression is altered, as part of an inflammatory response to damage or pathogenic insult, including metabolic, toxic, neurotoxic, iatrogenic, thermal or chemical insults, illustrative examples of which include trauma, surgery, drugs including chemotherapeutic drugs, radiation, disease including pathogenic infection, metabolic disease and ischemia, as well as foreign or implanted substances.

The term "immune system", as used herein, refers to cells, molecular components and mechanisms, including antigen-specific and non-specific categories of the adaptive and innate immune systems, respectively, that provide a defense against damage and insults and matter, the latter comprised of antigenic molecules, including but not limited to tumors, pathogens, and self-reactive cells.

The term "innate immune system" refers to a host's non-specific reaction to insult to include antigen-nonspecific defense cells, molecular components and mechanisms that come into action immediately or within several hours after exposure to almost any insult or antigen. Elements of the innate immunity include for example phagocytic cells (monocytes, macrophages, dendritic cells, polymorphonuclear leukocytes such as neutrophils, reticuloendothelial cells such as Küpffer cells, and microglia), cells that release inflammatory mediators (basophils, mast cells and eosinophils), natural killer cells (NK cells) and physical barriers and molecules such as keratin, mucous, secretions, complement proteins, immunoglobulin M (IgM), acute phase proteins, fibrinogen and molecules of the clotting cascade, and cytokines. Effector compounds of the innate immune system include chemicals such as lysozymes, IgM, mucous and chemoattractants (e.g., cytokines or histamine), complement and clotting proteins.

The term "adaptive immune system" refers to antigen-specific cells, molecular components and mechanisms that emerge over several days, and react with and remove a specific antigen. The adaptive immune system develops throughout a host's lifetime. The adaptive immune system is based on leukocytes, and is divided into two major sections: the humoral immune system, which acts mainly via immunoglobulins produced by B cells, and the cell-mediated immune system, which functions mainly via T cells.

Accordingly, in one example, an indicator is determined that correlates to a ratio of immune system biomarkers, which can be used in assessing a likelihood of a biological subject having a presence, absence, degree or prognosis of at least one medical condition.

In this example, the method includes determining a pair of biomarker values, each biomarker value being a value measured or derived for at least one corresponding immune system biomarker of the biological subject and being at least partially indicative of a concentration of the immune system biomarker in a sample taken from the subject.

The biomarker values are used to determine a derived biomarker value using the pair of biomarker values, the derived biomarker value being indicative of a ratio of concentrations of the pair of immune system biomarkers.

Thus, if the biomarker values are the concentrations of the biomarkers, then the derived biomarker value will be based on a ratio of the biomarker values. However, if the biomarker values are related to the concentrations of the biomarkers, for example if they are logarithmically related by virtue of the biomarker values being based on PCR cycle times, or the like, then the biomarker values may be combined in some other manner, such as by subtracting the cycle times to determine a derived biomarker value indicative of a ratio of the concentrations.

The derived biomarker is then used to determine the indicator, either by using the derived biomarker value as an indicator value, or by performing additional processing, such as comparing the derived biomarker value to a reference or the like, as will be described in more detail below.

In any event, combining biomarker values to determine a ratio of concentrations of immune system biomarkers, and then using this to determine an indicator allows indicators to be determined for use in determining a likelihood of a subject suffering from a range of different conditions, depending on the immune system biomarkers selected, which as it will be appreciated can be performed using the above described process.

A number of further features will now be described.

In one example, the process involves determining a first derived biomarker value using a first pair of biomarker values, the first derived biomarker value being indicative of a ratio of concentrations of first and second immune system biomarkers, determining a second derived biomarker value using a second pair of biomarker values, the second derived biomarker value being indicative of a ratio of concentrations of third and fourth immune system biomarkers and determining the indicator by combining the first and second derived biomarker values. Thus, in this example, two pairs of derived biomarker values can be used, which can assist in increasing the ability of the indicator to reliably determine the likelihood of a subject having a condition.

The derived biomarker values could be combined using a combining function such as an additive model; a linear model; a support vector machine; a neural network model; a random forest model; a regression model; a genetic algorithm; an annealing algorithm; a weighted sum; a nearest neighbor model; and a probabilistic model.

In one example, the indicator is compared to an indicator reference, with a likelihood being determined in accordance with results of the comparison. The indicator reference is typically derived from indicators determined for a number of individuals in a reference population. The reference population typically includes individuals having different characteristics, such as a plurality of individuals of different sexes; and/or ethnicities, with different groups being defined based on different characteristics, with the subject's indicator being compared to indicator references derived from individuals with similar characteristics. The reference population can also include a plurality of healthy individuals, a plurality of individuals suffering from at least one diagnosed medical condition, a plurality of individuals showing clinical signs of at least one medical condition and/or first and second groups of individuals, each group of individuals suffering from a respective diagnosed medical condition.

It will be appreciated that the individuals selected will depend on the intended use of the indicator. In particular, when the indicator is for use in determining the likelihood that a biological subject has a specific medical condition, the sample population includes individuals presenting with clinical signs of the specific medical condition, individuals diagnosed with the specific medical condition and healthy individuals. This ensures that the assessment of indicator validity applies regardless of not or whether the individual has the specific condition or not.

It will also be appreciated that the sample population could also include a plurality of individuals of different sexes, ethnicities, ages, or the like, allowing the control value ranges to be common across populations. However, this is not essential, and alternatively control value thresholds could be established that are specific to a particular sub-set of the population. In this case, it would be necessary to ensure that the control value threshold ranges used are appropriate for the subject under consideration.

The indicator can also be used for determining a likelihood of the subject having a first or second condition, in other words to distinguish between the conditions. In this case, this would typically be achieved by comparing the indicator to first and second indicator references, the first and second indicator references being indicative of first and second conditions and determining the likelihood in accordance with the results of the comparison. In particular, this can include determining first and second indicator probabilities using the results of the comparisons and combining the first and second indicator probabilities, for example using a Bayes method, to determine a condition probability corresponding to the likelihood of the subject having one of the conditions. In this situation the first and second conditions could include two medical conditions, or a single medical condition and a healthy condition.

In this case, the first and second indicator references are distributions of indicators determined for first and second groups of a reference population, the first and second group consisting of individuals diagnosed with the first or second condition respectively. In this regard, this can be achieved by determining first and second groups of individuals, each group of individuals having a presence or absence of a diagnosed medical condition and determining first and second indicator references for the first and second groups respectively. This allows the indicator to be used to distinguish between first and second conditions, which could include different medical conditions, as well as healthy conditions. It will also be appreciated that whilst two groups are described, this is not essential and three or more groups could also be defined.

The process is usually performed using at least one electronic processing device, such as a suitably programmed computer system or the like.

In this case, the electronic processing device typically obtains at least two pairs of measured biomarker values, either by receiving these from a measuring or other quantifying device, or by retrieving these from a database or the like. The processing device then determines a first derived biomarker value indicative of a ratio of concentrations of first and second immune system biomarkers and a second derived biomarker value indicative of a ratio of third and fourth immune system biomarkers. The processing device then determines the indicator by combining the first and second derived biomarker values.

The processing device can then generate a representation of the indicator, for example by generating an alphanumeric indication of the indicator, a graphical indication of a comparison of the indicator to one or more indicator references or an alphanumeric indication of a likelihood of the subject having at least one medical condition.

The method would also typically include obtaining a sample taken from the biological subject, the sample including polynucleotide expression products and quantifying at least some of the polynucleotide expression products within the sample to determine the pair of biomarker values. This can be achieved using any suitable technique, and will depend on the nature of the immune system biomarkers.

For example, if the indicator is based on a ratio of concentrations of the polynucleotide expression products, this process would typically include quantifying polynucleotide expression products by amplifying at least some polynucleotide expression products in the sample, determining an amplification amount representing a degree of amplification required to obtain a defined level of each of a pair of polynucleotide expression products and determining the indicator by determining a difference between the amplification amounts. In this regard, the amplification amount is generally a cycle time, a number of cycles, a cycle threshold and an amplification time.

In this case, the method includes determining a first derived biomarker value by determining a difference between the amplification amounts of a first pair of polynucleotide expression products, determining a second derived biomarker value by determining a difference between the amplification amounts of a second pair of polynucleotide expression products and determining the indicator by adding the first and second derived biomarker values.

As previously discussed, the at least two immune system biomarkers have a mutual correlation in respect of the at least one condition that lies within a mutual correlation range, the mutual correlation range being between ±0.9 and the indicator has a performance value greater than or equal to a performance threshold representing the ability of the indicator to diagnose the presence, absence, degree or prognosis of the at least one condition, the performance threshold being indicative of an explained variance of at least 0.3.

Typically the mutual correlation range is one of ±0.8; ±0.7; ±0.6; ±0.5; ±0.4; ±0.3; ±0.2; and, ±0.1.

Typically each immune system biomarker has a condition correlation with the presence, absence, degree or prognosis of the at least one condition that lies outside a condition correlation range, the condition correlation range being between ±0.3 and more typically ±0.9; ±0.8; ±0.7; ±0.6; ±0.5; and, ±0.4. Typically the performance threshold is indicative of an explained variance of at least one of 0.4; 0.5; 0.6; 0.7; 0.8; and, 0.9.

The above-described method has been used to identify 1650 biomarkers of inflammatory response syndromes (also referred to interchangeably herein as "IRS biomarkers" or "IRS immune system biomarkers"), which are useful for assisting in distinguishing: (1) between SIRS affected subjects (i.e., subjects having inSIRS or ipSIRS) and healthy subjects or subjects not affected by SIRS; (2) between subjects with inSIRS and subjects with ipSIRS; and/or (3) between subjects with different stages of ipSIRS (e.g., sepsis, severe sepsis and septic shock). Based on this identification, the present inventors have developed various methods, compositions, apparatus and kits, which take advantage of these biomarkers to provide an indicator for use in diagnosing the presence, absence or degree of at least one condition, or for prognosing at least one condition, wherein the at least one condition is selected from a healthy condition (e.g., a normal condition or one in which inSIRS and inSIRS are absent), inSIRS, ipSIRS, or a stage of ipSIRS (e.g., a stage of ipSIRS with a particular severity, illustrative examples of which include mild sepsis, severe sepsis and septic shock). In advantageous embodiments, the methods and kits involve monitoring the expression of IRS biomarker genes in cells of the immune systems, including blood cells (e.g., immune cells such as leukocytes), which may be reflected in changing patterns of RNA levels or protein production that correlate for example with the presence of active disease or response to disease.

The IRS biomarkers are expression products of genes (also referred to interchangeably herein as "IRS biomarker genes" or IRS immune system biomarker genes"), including polynucleotide and polypeptide expression products. As used herein, polynucleotide expression products of IRS biomarker genes are referred to herein as "IRS biomarker polynucleotides." Polypeptide expression products of the IRS biomarker genes are referred to herein as "IRS biomarker polypeptides." The term "gene", as used herein, refers to a stretch of nucleic acid that codes for a polypeptide or for an RNA chain that has a function. While it is the exon region of a gene that is transcribed to form RNA (e.g., mRNA), the term "gene" also includes regulatory regions such as promoters and enhancers that govern expression of the exon region.

Suitably, the IRS biomarker genes are selected from the group consisting of: PRKCZ, SKI, RER1, TAS1R1, VAMP3, AGTRAP, VPS13D, KLHDC7A, NBL1/C1orf151, MDS2, RCAN3, LDLRAP1, MAN1C1, SH3BGRL3, DHDDS, HCRTR1, CCDC28B, LCK, ZNF362, THRAP3, PPIE//CCDC25, CAP1, CTPS, C1orf84, FAAH, DMBX1, CYP4B1, BTF3L4, LRRC42, C1orf175//TTC4, TMEM61, FPGT//TNNI3K, ACADM, SPATA1, EPHX4, RPAP2, RPL5//SNORA66//SNORD21//FAM69A, RTCD1, SLC30A7, RNPC3//AMY2B, CELSR2, AHCYL1, CEPT1//DRAM2, CHIA, LIX1L, UPF0627, MRPS21, TNFAIP8L2, SMCP, DCST1, RAG1AP1, C1orf182, HAPLN2, NTRK1, CD1E, TOMM40L//NR1I3, POU2F1, TIPRL, SFT2D2, CACNA1E, SMG7, OCLM, RGS2, ZC3H11A//RP11-74E24.2, MFSD4, IL20, RPS6KC1, C1orf95, ARF1, GALNT2, TNFRSF4, NADK, FLJ14100//C1orf86, GPR153, RERE, SLC2A7, SDHB, RNF186, DDOST, GPN2, RPA2, PEF1, PTP4A2, TRIM62, PHC2, LSM10, MRPS15, RRAGC, COL9A2, TESK2, NRD1, KTI12, CC2D1B, YIPF1, JAK1, SLC35D1, DIRAS3, ZZZ3, GNG5, ZNHIT6, ODF2L, SEP15, BARHL2, GCLM, CLCC1/GPSM2//C1orf62, SORT1, SLC16A4, PHTF1, RSBN1, DENND2C//BCAS2, CD58, SPAG17//WDR3, REG4//NBPF7, RP11-94I2.2//NBPF16//NBPF11//NBPF15//NBPF8//NBPF20//NBPF10//NBPF14//NBPF1//LOC100288142//NBPF12//KIAA1245//LOC100290137, APH1A, POGZ, TDRKH, THEM4, S100A11, CRNN, SPRR2C, S100A12, S100A8, GATAD2B//PLIN2, DENND4B, PBXIP1, PYGO2, SHC1, DCST2, GBA//GBAP, ASH1L, RITZ, MEF2D, AIM2, COPA, DEDD, TADA1L, GPA33, CD247, F5, PIGC, KIAA0040, TOR1A1P2//TOR1A1P1//1FRG15, STX6//KIAA1614, EDEM3, UCHL5, DENND1B, DDX59, KIF21B, ARL8A, CYB5R1, MYBPH, CHI3L1, PIK3C2B//LOC100130573, NUAK2, NUCKS1, FAIM3, PLXNA2, SLC30A1, LPGAT1, ANGEL2, RAB3GAP2//AURKAPS1/AURKA//SNORA36B, TP53BP2, NVL, TMEM63A, PARP1, ITPKB, TARBP1, CHML, AKT3, SMYD3, AHCTF1, OR1C1, NCOA1, HADHB, ABHD1//PREB, SPAST, SLC30A6//DDX50, CRIPT, MSH2, FOXN2, CCDC104, VRK2, AHSA2//USP34, OTX1, AFTPH, CEP68, PLEK, ANXA4, MXD1, NAGK, SMYD5//NOTO, MTHFD2, TTC31, SEMA4F, TMSB10, SH2D6, GNLY, KCNIP3, CNNM4, CNNM3, ZAP70, LIP T1//MRPL30, MAP4K4, IL1R2, IL1R1, IL18R1, POLR1B, CHCHD5, IL1RN, PSD4, DDX18, INSIG2, TMEM177//LOC100125918, RALB, PROC, GPR17//LOC100291428//LIMS2, IMP4, FAM123C, ACVR2A, MBD5, LYPD6B, SLC4A10, UBR3, HAT1, ITGA6, ZAK, OSBPL6, PLEKHA3, ZC3H15, COL3A1, GLS, OBFC2A, COQ10B, MARS2, CFLAR, NOP58, FAM117B, CYP20A1, FASTKD2, PIKFYVE, C2orf62, SLC11A1, AGFG1, CHRNG, EIF4E2, TRPM8, LRRFIP1, GAL3ST2, TMEM18, LAPTM4A, SF3B14, TP53I3, UNQ2999, GPR113//SELI, MPV17, PPM1G, NLRC4, CDC42EP3, HNRPLL, COX7A2L, KCNG3, CALM2//C2orf61, BCL11A, XPO1, NAT8B, DUSP11, MOGS, SNRNP200, SEMA4C, MITD1, ILIA, SLC35F5, CCDC93, CLASP1, SAP130, YSK4, GTDC1, ORC4L, NR4A2//FLJ46875, DPP4, GALNT3, SCN7A, FRZB, STK17B, CLKH/PPIL3, MPP4, INO80D, KLF7, FAM119A, NGEF, ARL4C, RAB17, HDLBP, LRRN1, SETD5, IRAK2, C3orf42, TSEN2, NR2C2//MRPS25, UBE2E1, C3orf35, SNRK, ZNF197, GNAI2, ALAS1, PRKCD, CACNA1D, PXK, PTPRG, ATXN7, SLC35A5, SLC15A2, CCDC48, DNAJC13, CLDN18, GYG1, SELT, MED12L, RAP2B, MYNN, ABCF3, VPS8, HRG, EIF4A2//SNORA4, LPP, CCDC50, LOC152217, TADA3L, SEC13, TIMP4, METTLE, DAZL//DAZ4//DAZ3//DAZ2, SATB1//TBC1D5, SCN10A, SEC22C, ZDHHC3, ZDHHC3, SLC6A20, UQCRC1, PRKAR2A, IMPDH2, CCDC71, UBA7, CAMKV, WDR82, LMOD3, FOXP1, MORC1, ATG3, GSK3B//LOC100129275, HCLS1, KPNA1, PTPLB, C3orf22, RPN1, KIAA1257//ACAD9//LOC100132731, FOXL2, MECOM, PLD1, GNB4, MRPL47, KLHL6, THPO, ETV5, BCL6//LOC100131635, ATP13A5, TMEM44, KIAA1530, TACC3, CNO, BST1, KLF3, TMEM33//DCAF4L1, KIT, ENAM, FAM47E//STBD1, ENOPH1, PDLIM5, CCDC109B//HIGD1A//CCDC13, EGF, PCDH10, RAB33B, TMEM184C, RBM46, GRIA2, C4orf39, KLHL2, TLL1, F11, SLBP, HAUS3//POLN, PPARGC1A, TLR10, C4orf34, TXK, RPL21P44, KDR, RCHY1, CNOT6L, PLACE, HPSE, GPRIN3, PPA2, COL25A1, C4orf3, QRFPR, MFSD8, MAP9, PDGFC, TKTL2, ACSL1, SUBH/TMEM183A, CARD6, MCCC2, TNPO1, PDE8B, PAPD4, THBS4, FAM151B, RASGRF2, SNX2, LMNB1//PCIF1, MEGF10, LEAP2, TCF7, KDM3B, CXXC5, SLC4A9, ANKHD1-EIF4EBP3//ANKHD1//EIF4EBP3, KIAA0141, GRPEL2, MFAP3, GABRA6, GABRA1, DOCK2, RANBP17//USP12, ERGIC1, ATP6V0E1//SNORA74B, ZNF346, NSD1, CLPTM1L, UGT3A1, GDNF, TTC33, hCG_2039148, MOCS2, SLC38A9, CCDC125, ANKRA2, HAPLN1, CCNH, TMEM161B, MBLAC2, MCTP1, TICAM2//TMED7//TMED7-TICAM2, KIF3A, C5orf15, SKP1, CXCL14, KLHL3, CD14, YIPF5, LARS, DCTN4, CCDC69, ATOX1, TIMD4, ADAM19, SLIT3, RNF44, DOK3, MGAT4B//SQSTM1, C5orf45//SQSTM1, RASGEF1C, MGAT1, IRF4, HIVEP1, E2F3, HIST1H4I, HIST1H2BM, MOG, ZNRD1//NCRNA00171, TRIM15, HCG27, BAT2//SNORA38, CYP21A2, ITPR3, MAPK14, MAPK13, PNPLA1, SFRS3, CDKN1A, FOXP4, CUL9, RUNX2, ZNF451, SOBP, C6orf182, KIAA1919, RWDD1, KPNA5, TPD52L1, ARG1, RAB32, ARID1B, SLC22A3, SERPINB1, C6orf146, GCM2, ATXN1, DCDC2//KAAG1, HIST1H3I, HIST1H4L, GABBR1, RNA243, DDAH2, CLIC1, NEU1, RXRB, VPS52, TCP11, CLPS, PGC, ZNF318, YIPF3, MRPL14, PLA2G7, PKHD1, IL17F, HTR1B, GABRR2, UBE2J1, BACH2, MCM9, VNN1, IL20RA, FLJ27255, T, RPS6KA2, HGC6.3, UNC84A//C7orf20, SDK1, ZDHHC4, C7orf26, GLCCI1//tcag7.903, GPNMB, CCDC126, WIPF3//ZNRF2//LOC441208, GPR141, STARD3NL, POU6F2, CDC2L5, ZMIZ2, UPP1, ZNF273, KCTD7//RABGEF1, RABGEF1//tcag7.967//tcag7.951//KCTD7//LOC100293333, CCDC132, PVRIG//PILRB//STAG3, PILRB//PVRIG//STAG3, C7orf51, GNB2, LRRC17, LRRN3, CFTR, LSM8, LUC7L2, MGAM//LOC100124692, GIMAP7, INSIG1, RBM33, ICA1, FAM126A, HIBADH, TRIL, SCRN1, ELMO1, INHBA, CAMK2B, NPC1L1, DDC//LOC100129427, NSUN5//NSUN5B//NSUN5C, CLDN3, C7orf23//DMTF1, SRI, BET1, MCM7, GATS, ATXN7L1//RINT1//EFCAB10, KIAA1549, SLC37A3, SMARCD3, MLL3//BAGE2, CLN8, MSRA, PIWIL2, NEFM//LOC100129717, EPHX2, LEPROTL1, MAK16//C8orf41, AP3M2, FNTA, SGK196, UBE2V2, FLJ46365, SNTG1, TRIM55, C8orf45, PREX2, PLEKHF2, BAALC//FLJ10489, TTC35, MTBP, ZHX2, RNF139, TG, DENND3//C8orf60, TNFRSF10D, TRIM35, GSR, WHSC1L1, PCMTD1//PXDNL, NCOA2, TRAM1//LOC286190, RUNX1T1, EXT1, DDEF1IT1, CDC37L1, UBE2R2, UBAP1//KIF24, GALT, RGP1//GBA2, TGFBR1, C9orf6//IKBKAP, IMAGE5303689, ATP6V1G1, TLR4, SET, MRPL41, C9orf68, HAUS6//SCARNA8, KLHL9, C9orf82, NDUFB6//DFFB, SIT1, FAM108B1, TRPM6, FRMD3, SLC28A3, BICD2, C9orf84, AKNA, MEGF9, C5, GOLGA1//SCAI, SH2D3C, FAM102A, FLJ10232, ASB6, BAT2L, EDF1, FBXW5, C10orf18, FBXO18, GATA3, CUGBP2, VIM, STAM, WAC, BAMBI, ZNF487//LOC439911, ALOX5, WDFY4, SRGN, CCDC109A, FAM149B1//FAM149B2, MINPP1, PTEN//PTENP1, ENTPD1//C10orf131, ABCC2, SFXN2, SHOC2, ACSL5, BCCIP//DHX32, FAM188A, CUBN, SVIL//hCG_1783494, FAM13C//PHYHIPL, ATAD1, ANKRD22, FLJ34077, COX15, ERLIN1, ACTR1A, ABLIM1, RAB11FIP2, C10orf84, PRDX3, C10orf119, NSMCE4A, TALDO1//INTS8, TNNT3, FXC1, PDE3B, DNAJC24, PTPRJ//OR4B1, C11orf31, TMEM109, CD6, CD5, TMEM138, POLR2G, TMEM179B, NAT11, OTUB1, RBM14//RBM4, AIP, PPFIA1, IL18BP//NUMA1, C11orf30, C11orf82, TMEM126B, C11orf73, PIWIL4, LOC100132686, PAFAH1B2, UBE4A, TRAPPC4, SC5DL, VWA5A//OR10D1P, STT3A, VPS26B, TRIM21, ZBED5, SAAL1, FANCF, LIN7C, PHF21A, CUGBP1, OSBP, CYBASC3, TUT1, SLC25A45, LTBP3, EIF1AD, GAB2, CREBZF, PICALM, SLC36A4, CCDC82, KIAA1826, MPZL3, MPZL2, H2AFX, SIAE, ZBTB44, HSN2, ADIPOR2, NCAPD2//SCARNA10//FADS1, PTPN6, CLEC4D, CDKN1B, GOLT1B, FAR2, FGD4, TMEM106C, TMBIM6, C12orf62, PRR13//PCBP2, DGKA, COQ10A, TSPAN31, CDK4//MARCH9/C3HC4, LEMD3, IRAK3, TMTC3, ACTR6, TCTN1, PXMP2//PGAM5, DCP1B, SLC2A3//SLC2A14, C3AR1, PLBD1, TM7SF3, ASB8//PHB, LMBR1L, FMNL3//PRPF40B, AAAS, NFE2, GPR84, CD63, SARNP//DNAJC14, NACA, CDK4//TSPAN31, TMBIM4//LOC100133322, IL22, LIN7A, HAL, APPL2, GLTP, GIT2, VPS29, PPTC7, DDX54//CCDC42B, SLC24A6, SDS, RBM19, MED13L, C12orf49, FBXO21, WSB2, TAOK3, CIT, RAB35, RPLP0, PXN, TRIAP1, SFRS9, POP5, UNQ1887, C12orf43, ANAPC5, KDM2B, MORN3, TMEM120B//RHOF, LOC338799, DIABLO//B3GNT4, VPS33A, CLIP1, PITPNM2, EIF2B1, CCDC92, NCOR2, DHX37, DDX51, POLE, GOLGA3, ZMYM2, SPATA13//C1QTNF9, NUPL1, PAN3//EEF1A1//CHCHD2, ALOX5AP, EEF1DP3, KL, UFM1, NARG1L, ITM2B, FNDC3A, CDADC1, ARL11, LMO7, DNAJC3, TM9SF2, CLYBL, PCCA, ABHD13, LAMP1, TMCO3, UPF3A, ZMYM5//ZMYM2, ZDHHC20//LOC728099, PARP4, MTMR6//LOC646482, HSPH1, N4BP2L2//CG030, ELF1, LCP1, KPNA3, C13orf1, DLEU2//DLEU2L, GUCY1B2, INTS6, DACH1, TBC1D4, EDNRB, UGGT2, GPR183, LIG4, ANKRD10, RASA3, RNASE2//LOC643332, RPGRIP1, IRF9, TSSK4, C14orf21, SCFD1, FANCM, ABHD12B, PTGDR, FBXO34//KIAA0831, C14orf101, ACTR10, ARID4A, JKAMP, HIF1A, SYNE2, EXD2, SLC39A9, SFRS5, PCNX, SIPA1L1//SNORD56B//LOC145474//LOC283567, YLPM1, BATF, FLVCR2//RPS24, GPR65, TDP1, EVL, ZNF839, TDRD9, INF2, PLD4, MTA1//LOC647310//LOC100128343, NDRG2, DAD1//OR6J1, SLC7A8, IPO4, TM9SF1, ADCY4, RIPK3, EAPP, BAZ1A, NFKBIA, SEC23A, C14orf104, C14orf138, SOS2, NIN, PYGL, CNIH, DHRS7, WDR89, ACTN1, NUMB, C14orf43, ABCD4, KIAA0317, NEK9, ANGEL1, SPTLC2, SERPINA6, DICER1, BCL11B, ANKRD9, PPP1R13B, AKT1, BRF1, TUBGCP5, SNRPN//SNURF//IPW//SNORD116-16//SNORD116-18//SNORD116-21//SNORD116-22//SNORD116-17//SNORD116-19//PAR5//PAR-SN//SNORD116-2//SNORD116-25//SNORD116-26//SNORD107//SNORD115-12//SNORD115-5//SNORD115-6//SNORD115-9//SNORD116-11//SNORD116-12//SNORD116-13//SNORD116-28//SNORD116-4//SNORD64//PAR1//SNORD109A//SNORD109B//SNORD116-6//SNORD116-3//SNORD116-9//SNORD115-13//SNORD115-1//SNORD115-14//SNORD115-15//SNORD115-2//SNORD115-10//SNORD115-7//SNORD115-16//SNORD115-40//SNORD115-42//SNORD115-11//SNORD115-29//SNORD115-34//SNORD115-36//SNORD115-4//SNORD115-43//HBII-52-24//SNORD116-5//SNORD116-7//SNORD115-26//

SNORD115-30//SNORD116-15//SNORD116-8// SNORD115-2//SNORD115-39//SNORD116-14// SNORD116-20//SNORD116-8//SNORD115-3// SNORD116-38//SNORD115-41//SNORD115-22// SNORD115-44//SNORD116-1//SNORD115-17// SNORD115-18//SNORD115-19//SNORD115-20// SNORD116@, APBA2, MTMR15//MTMR10, RYR3, BAHD1, CHP, JMJD7-PLA2G4B//JMJD7//PLA2G4B, HAUS2, C15orf63//SERF2, B2M, TRIM69, PLDN, SQRDL, GALK2, USP8, GLDN, MAPK6, LACTB, RAB8B, APH1B, USP3//LOC100130855, SNX1, LBX-COR1/PIAS1//CALML4, NEO1, MPI, FBXO22// FBXO22OS, RCN2, FAH, IL16, ABHD2, SLCO3A1, MCTP2, MEF2A//LYSMD4, NIPA2//CYFIP1, HERC2// HERC2P2//HERC2P3//LOC440248, MTMR10//MTMR15, C15orf24, SLC12A6, LPCAT4, INO80, OIP5, ZFP106, CDAN1, SPG11//ISLR, SPPL2A, GNB5//LOC100129973, MYO5A, ARPP19, RAB27A, CCPG1//PIGB//DYX1C1, BNIP2, CA12, FAM96A, KIAA0101//CSNK1G1, TLE3, PARP6, NPTN, MAN2C1, IMP3, MTHFS, ST20// C15orf37, TMC3, AP3B2, C15orf40, WDR73, NTRK3, DET1, TM2D3, WDR90, RHOT2//FBXL16, TMEM204, CRAMP1L//HN1L, MAPK8IP3, TBL3, TSC2, KCTD5// PRO0461//PDPK1, CLUAP1, DNASE1, DNAJA3, CP110, C16orf62, LYRM1, METTL9, EEF2K, POLR3E, PLK1, PRKCB, IL21R//LOC283888, SULT1A2//SULT1A1, ATXN2L, LAT//SPNS1//NPIPL2//LOC728741// LOC730153//NPIPL3//SPIN1/LOC728888// LOC100289169//LOC728734//LOC729602// LOC100288442//LOC100288332, KIF22, MAZ, CORO1A//LOC606724, ITGAL, SRCAP//SNORA30, ZNF646//ZNF668, C16orf67, TMEM188, LPCAT2, CETP, CKLF, CMTM1//CKLF, TMEM208, CTCF, THAP11, NUTF2, EDC4, SLC7A6//SLC7A6OS, PRMT7, SNTB2, VPS4A, DDX19B//DDX19A, CHST4, HP//HPR, PLCG2, KLHL36, KIAA0182, BANP//RUNDC2C, TRAPPC2L, SPG7, CDK10, TCF25, AFG3L1, LUC7L, AXIN1, JMJD8, LMF1, UNKL, UNKL, CLCN7, MRPS34, RNPS1, NLRC3, TRAP1//DNASE1, ADCY9, CORO7, C16orf72, RRN3//LOC653390//LOC730092//LOC100131998, XYLT1/LYRM2//ZC3H11A, DCUN1D3//LYRM1, IGSF6// METTL9, CDR2//RRN3//LOC100131998//LOC653390, COG7, GGA2, NSMCE1, GTF3C1, CCDC101// LOC388242, C16orf54, KCTD13, SEPT1, ZNF764// ZNF747, C16orf58//LOC100128371, ITFG1, ABCC11// LONP2, NUDT21, BBS2//OGFOD1, CSNK2A2, GOT2, FAM96B, FHOD1//SLC9A5, ATP6VOD1// LOC100132855, GFOD2, SLC12A4, DPEP3, DPEP2, CHTF8//HAS3, COG8//PDF, TERF2, AARS, ST3 GAL2, VAC14//LOC100130894, APIG1, WDR59, CTRB2// CTRB1, TAF1C//ADAD2, FBXO31, ZCCHC14, FAM38A, CENPBD1, TIMM22, RPA1, DPH1//OVCA2, SGSM2, ARRB2, LOC100130950, DNAH2, PIGL, TRPV2, MPRIP, DRG2, ALKBH5//FLJ13773, SMCR7, WSB1, TAOK1, CPD, SUZ12P, RNF135, ZNF830, TAF15, GGNBP2, LASP1, PSMD3, CDC6, NBR2, TMUB2, MGC57346// C17orf69, NSF//LOC728806, GOSR2, NPEPPS// TBC1D3F//LOC440434, KPNB1, CDK5RAP3, ATP5G1, UBE2Z, XYLT2//LOC100130580, NOG, DGKE, AKAP1, TMEM49//CLTC//MIR21, CLTC, CA4, C17orf64, DCAF7, PITPNC1, NOL11//SNORA38B, MAP2K6, COG1, CD300A, TMEM104, MRPS7, KIAA0195, T5EN54, LLGL2, LOC100134934//CDK3, MFSD11, SEPT9, TNRC6C, TMC8, ENGASE, RPTOR, GPS1, FN3KRP, TBCD, GEMIN4, GLOD4, SLC43A2, PRPF8, SMG6// C17orf6, METT10D//LOC284009, SHPK, TAX1BP3, P2RX5, MYBBP1A//SPNS2, PELP1, PFN1, ZNF232, DHX33, DERL2, NLRP1//LOC728392, ASGR2, NEURL4//GPS2//D4S234E, ZBTB4, TP53, VAMP2, PIK3R5, ELAC2, NCOR1//C20orf191//LOC100131704, ZNF287, TOM1L2//LOC246315, GRAP//SNORD3B-1// SNORD3B-2//LOC400581, ALDOC, SDF2, RAB34, PHF12, NUFIP2, OMG, EVI2B, C17orf66//RSL24D1, SYNRG//LOC100131822, PLXDC1, CACNB1, PGAP3, MED24, NR1D1//THRA, CCR7, STAT5B//STAT5A, FAM134C, VAT1, DUSP3, C17orf65//ASB16, UBTF, GPATCH8, MAP3K14//LOC100133991, OSBPL7, SLC35B1, TOB1, COX11//TOM1L1, VEZF1, SFRS1// FLJ44342, SEPT4, MED13//LOC100129112, LIMD2// MAP3K3, STRADA, FTSJ3, CD79B, ICAM2, ERN1, TEX2, LRRC37A3//LRRC37A2//LRRC37A//ARL17P1// LRRC37A4//LOC100294335//LOC644397, GNA13, WIPI1//ARSG, FAM20A, NAT9, GGA3, H3F3B//H3F3C, EXOC7, SFRS2, TMC6//LOC100131096, USP36, CD7, RAB31, VAPA, SEH1L, HQ0644/PRO0644, RNMT, RNF138, GALNT1, ELP2, PIK3C3, SLC14A2, ME2, SER-PINB2//SERPINB10, ZNF407, ZNF236, NFATC1// LOC100127994, ENOSF1//TYMS, MYOM1, AFG3L2, ABHD3, OSBPL1A, CDH2, DSC1, PSTPIP2, C18orf32, MBD2//SNORA37, PIGN, TMX3, PQLC1, GZMM, ARID3A, CIRBP, DAZAP1, SPPL2B, NFIC, VAV1, ARHGEF18//LOC100128573, STXBP2//L00554363// LOC100131801, C19orf59, ZNF317, ILF3, SMARCA4, PRKCSH, IER2, CCDC130, DCAF15, IL27RA, KLF2, SIN3B, DDA1, GTPBP3, FAM129C, FCHO1, ARRDC2, IFI30, C19orf60, CRTC1//MAML2, RFXANK//MEF2B// LOC729991, ZNF101, ZNF738, ZNF257//ZNF492// ZNF99//ZNF98//LOC646864, C19orf2, KIAA0355// FLJ21369, USF2, TMEM147, LIN37//PSENEN, C19orf55, TBCB//POLR2I, ZNF382, ZNF568, ZNF420, ZNF383, CCDC97, ZNF574, CD177, ZNF230//ZNF222, VASP, GRWD1, FLT3LG, ZNF175, NCRNA00085, PPP2R1A, ZNF808//ZNF578//ZNF611, LENG8, FCAR, RPL28, U2AF2, LOC100288114//MGC9913, ZFP28, ZNF460, ZNF549, ZNF211, ZNF587//ZNF417, ZNF274, ZNF544, ZNF8, TRIM28, C19orf6, C19orf34, GNG7, AES, EEF2// SNORD37, PLIN5ARG1, PLIN3, PTPRS, SAFB2//SAFB, RANBP3, GTF2F1//LOC100130856, XAB2, ELAVL1, ADAMTS10, FBXL12, DNMT1, TYK2, KEAP1, KRI1, TMEM205//hCG_29977, ZNF563, MAN2B1//MORG1, C19orf56, DHPS, TNPO2//SNORD41, LPHN1, NDUFB7, AKAP8, AKAP8L, CHERP//C19orf44//CALR3, INSL3// JAK3, IL12RB1, UPK1A, TYROBP, ZNF529, ZNF461, ZNF607, YIF1B, PRR13, CEACAM4, PLAUR, TRAPPC6A, ERCC1//CD3EAP, RTN2, SYMPK, PGLYRP1, NOSIP, PNKP, NKG7, FPR1, ZNF28, OSCAR, MBOAT7, LILRA5, LILRA4, ZNF550//ZNF549, ZNF416, ZNF256, ZNF329, FAM110A, ITPA, CDC25B, CDS2, CRLS1, CSRP2BP, SEC23B, SLC24A3, HCK, ASXL1, ACSS2, C20orf4, TGIF2, C20orf24//SLA2, RPN2// EEF1A2, CTNNBL1, ACTR5, PPP1R16B, DHX35, PLCG1, MYBL2, SYS1//SYS1-DBNDD2//DBNDD2, DNTTIP1, CTSA, MMP9//LOC100128028, DDX27, SLC9A8, RNF114, PTPN1, TSHZ2, PFDN4, CSTF1, CASS4, GNAS, C20orf177, CDH26, C20orf197, LOC284757, ARFGAP1, PRPF6, NSFL1C, SIRPD, SIRPG//SIRPA, RNF24, RASSF2, TMX4, JAG1, C20orf74, C20orf3, C20orf112, CDK5RAP1, AHCY, GGT7, EDEM2, RBM39//LOC643167, BLCAP, SERINC3//TTPAL, ZNF335, ELMO2, B4GALT5, DPM1, ZFP64, ZNF217, CTSZ, SYCP2, PSMA7, DIDO1, YTHDF1, CHODL, BACH1, C21orf41//BACH1, IL10RB, IFNAR1, IFNGR2, SON, MORC3//DOPEY2, DYRK1A, KCNJ15, ETS2, RRP1B, PFKL, TRPM2, ADARB1, SAMSN1//

LOC388813, N6AMT1, SYNJ1, TMEM50B, KCNE1, PRDM15, C2CD2, WDR4, U2AF1, CSTB, UBE2G2//SUMO3, PTTG11P, POFUT2, MCM3AP, IL17RA//CECR7, C22orf37, LZTR1, PPIL2//YPEL1, CYTSA, SNRPD3//C22orf13, NF2, LIMK2, SLC5A1, MCM5, NCF4, GGA1, SH3BP1//PDXP, POLR2F//LOC100131530, APOBEC3A//APOBEC3B, APOBEC3D, ATF4, CACNA1I, ZC3H7B, CCDC134, TSPO, NUP50, TBC1D22A//LOC100289878, RP3-402G11.5, SAPS2, NCAPH2, BID, SLC25A1, KLHL22//KRT18, PI4KA//PI4KAP1//PI4KAP2//LOC100293141, MAPK1, ZNF70, TPST2, SF3A1//CCDC157, PES1, PIK3IP1, PATZ1, C22orf30, IL2RB, CSNK1E//LOC400927, UNC84B, CBX7//LOC100128400, RPS19BP1, MKL1//KIAA1659, RANGAP1, TCF20, LDOC1L, UNQ6126, TUBGCP6, SBF1//SBF1P1, MSL3, MOSPD2, BMX//HNRPDL, PDHA1, YY2, PDK3, GK//GK3P//FTL//LOC652904, CXorf59, ATP6AP2, USP9X//USP9Y, RP2, USP11, RBM3, FTSJ1, WAS, PLP2, TSPYL2//GPR173, MAGED2, UBQLN2, NLGN3, ACRC, UPRT, CXorf26, ATP7A, DIAPH2, CSTF2//RAD21, ARMCX3, ARMCX5, GPRASP1, TMEM31, TBC1D8B, MID2, DOCK11, LONRF3, UBE2A, SH2D1A, OCRL, SLC25A14, HPRT1, CD40LG, AFF2, SSR4//IDH3G, FAM50A, DKC1//SNORA36A//SNORA56, ARSD, KAL1, CTPS2, RPS6KA3, BCOR, MAOB//NAT13, ZNF41, OTUD5, KCND1, ZMYM3, MAGT1, BRWD3, TRMT2B, GLA, MORF4L2, PSMD10, ACSL4, LAMP2, CUL4B, ODZ1, ELF4, RAP2C, FAM127B//FAM127C//FAM127A, TMEM185A, ARD1A, IRAK1, DNASE1L1//RPL10, SH3KBP1, Mitochondrial, Mitochondrial, CCNL2, INPP5B, TLR5, ADRB3//GOT1L1, NOC2L//SAMD11//LOC401010 and SHFM1 (hereafter referred to interchangeably herein as "the full list of IRS immune system biomarker genes" or "full list IRS biomarker genes").

The methods, compositions, apparatus and kits of the present invention take advantage of the IRS biomarkers broadly described above and elsewhere herein to provide an indicator for use in diagnosing the presence, absence or degree of the at least one condition selected from a healthy condition (e.g., a normal condition or one in which inSIRS and inSIRS are absent), inSIRS, ipSIRS or a stage of ipSIRS (e.g., a stage of ipSIRS with a particular severity such as mild sepsis, severe sepsis and septic shock), or in providing a prognosis of the at least one condition, which may involve: (a) determining a plurality of IRS biomarker values, each IRS biomarker value being indicative of a value measured or derived for at least one (e.g., 1, 2, 3, 4, 5, 6, 7, 8, 9, 10, or more) IRS biomarker of a biological subject; (b) determining the indicator using a combination of the plurality of IRS biomarker values (also referred to herein as a "biomarker signature"), the indicator being at least partially indicative of the presence, absence, degree or prognosis of the at least one condition, wherein: (i) at least two (e.g., 2, 3, 4, 5, 6, 7, 8, 9, 10, or more) IRS biomarkers have a mutual correlation in respect of the at least one condition that lies within a mutual correlation range, the mutual correlation range being between ±0.9; and (ii) the indicator has a performance value greater than or equal to a performance threshold representing the ability of the indicator to diagnose the presence, absence or degree of the at least one condition, or to provide a prognosis for the at least one condition, the performance threshold being indicative of an explained variance of at least 0.3.

In advantageous embodiments, the diagnostic or prognostic methods, compositions, apparatus and kits of the present invention involve: (1) determining a plurality of measured IRS biomarker values, each measured IRS biomarker value being a measured value of an IRS biomarker of the biological subject; and (2) applying a function to at least one of the measured IRS biomarker values to determine at least one derived IRS biomarker value, the at least one derived IRS biomarker value being indicative of a value of a corresponding derived IRS biomarker. The function suitably includes at least one of: (a) multiplying two IRS biomarker values; (b) dividing two IRS biomarker values; (c) adding two IRS biomarker values; (d) subtracting two IRS biomarker values; (e) a weighted sum of at least two IRS biomarker values; (f) a log sum of at least two IRS biomarker values; and (g) a sigmoidal function of at least two IRS biomarker values.

In some embodiments, the diagnostic or prognostic methods, compositions, apparatus and kits involve: determining at least one derived IRS biomarker value corresponding to a ratio of two measured IRS biomarker values. In these examples, the diagnostic or prognostic methods, apparatus and kits suitably include combining at least two IRS biomarker values to determine an indicator value representing the indicator and in illustrative examples of this type, the at least two IRS biomarker values are combined using a combining function (e.g., any one or more of: an additive model; a linear model; a support vector machine; a neural network model; a random forest model; a regression model; a genetic algorithm; an annealing algorithm; weighted sum; a nearest neighbor model; and a probabilistic model). Suitably, the diagnostic or prognostic methods, apparatus and kits include: (a) determining a first derived IRS biomarker value, the first derived IRS biomarker value being a ratio of first and second measured IRS biomarker values; (b) determining a second derived IRS biomarker value, the second derived IRS biomarker value being a ratio of third and fourth measured IRS biomarker values; and (c) adding the first and second derived IRS biomarker values to generate an indicator value.

In some embodiments, the methods, compositions, kits and apparatus of the present invention are useful for diagnosing that inSIRS or a healthy condition is present or absent in the biological subject, which suitably involve: (a) determining a plurality of IRS biomarker values, each IRS biomarker value being indicative of a value measured or derived for at least one IRS biomarker of a biological subject; (b) determining the indicator using a combination of the plurality of IRS biomarker values, the at least one indicator being at least partially indicative of the presence, absence, degree or prognosis of the at least one condition selected from inSIRS and a healthy condition, wherein: (i) at least two IRS biomarkers have a mutual correlation in respect of the at least one condition that lies within a mutual correlation range, the mutual correlation range being between ±0.9; and (ii) the indicator has a performance value greater than or equal to a performance threshold representing the ability of the indicator to diagnose the presence, absence or degree of the at least one condition, or to provide a prognosis for the at least one condition, the performance threshold being indicative of an explained variance of at least 0.3, wherein at least one of the at least two IRS biomarkers is selected from a first IRS biomarker group and wherein at least one other of the at least two IRS biomarkers is selected from a second IRS biomarker group, wherein the first IRS biomarker group consists of polynucleotide and/or polypeptide expression products from group A IRS biomarker genes as defined herein, and wherein the second IRS biomarker group consists of polynucleotide and/or polypeptide expression products from group B IRS biomarker genes as defined herein.

In other embodiments, the methods, apparatus and kits are useful for diagnosing that ipSIRS or a healthy condition is present or absent in the biological subject, which suitably involve: (a) determining a plurality of IRS biomarker values, each IRS biomarker value being indicative of a value measured or derived for at least one IRS biomarker of a biological subject; (b) determining the indicator using a combination of the plurality of IRS biomarker values, the at least one indicator being at least partially indicative of the presence, absence, degree or prognosis of the at least one condition selected from ipSIRS and a healthy condition, wherein: (i) at least two IRS biomarkers have a mutual correlation in respect of the at least one condition that lies within a mutual correlation range, the mutual correlation range being between ±0.9; and (ii) the indicator has a performance value greater than or equal to a performance threshold representing the ability of the indicator to diagnose the presence, absence or degree of the at least one condition, or to provide a prognosis for the at least one condition, the performance threshold being indicative of an explained variance of at least 0.3, wherein at least one of the at least two IRS biomarkers is selected from a first IRS biomarker group and wherein at least one other of the at least two IRS biomarkers is selected from a second IRS biomarker group, wherein the first IRS biomarker group consists of polynucleotide and/or polypeptide expression products from group C IRS biomarker genes, as defined herein, and wherein the second IRS biomarker group consists of polynucleotide and/or polypeptide expression products from group D IRS biomarker genes as defined herein.

In still other embodiments, the methods, apparatus and kits are useful for diagnosing that inSIRS or ipSIRS is present or absent in the biological subject, which suitably involve: (a) determining a plurality of IRS biomarker values, each IRS biomarker value being indicative of a value measured or derived for at least one IRS biomarker of a biological subject; (b) determining the indicator using a combination of the plurality of IRS biomarker values, the at least one indicator being at least partially indicative of the presence, absence, degree or prognosis of the at least one condition selected from inSIRS and ipSIRS, wherein: (i) at least two IRS biomarkers have a mutual correlation in respect of the at least one condition that lies within a mutual correlation range, the mutual correlation range being between ±0.9; and (ii) the indicator has a performance value greater than or equal to a performance threshold representing the ability of the indicator to diagnose the presence, absence or degree of the at least one condition, or to provide a prognosis for the at least one condition, the performance threshold being indicative of an explained variance of at least 0.3, wherein at least one of the at least two IRS biomarkers is selected from a first IRS biomarker group and wherein at least one other of the at least two IRS biomarkers is selected from a second IRS biomarker group, wherein the first IRS biomarker group consists of polynucleotide and/or polypeptide expression products from group E IRS biomarker genes as defined herein, and wherein the second IRS biomarker group consists of polynucleotide and/or polypeptide expression products from group F IRS biomarker genes as defined herein.

In other embodiments, the methods, apparatus and kits are useful for diagnosing that inSIRS or ipSIRS is present or absent in the biological subject, which suitably involve: (a) determining a plurality of IRS biomarker values, each IRS biomarker value being indicative of a value measured or derived for at least one IRS biomarker of a biological subject; (b) determining the indicator using a combination of the plurality of IRS biomarker values, the at least one indicator being at least partially indicative of the presence, absence, degree or prognosis of the at least one condition selected from inSIRS and ipSIRS, wherein: (i) at least four IRS biomarkers have a mutual correlation in respect of the at least one condition that lies within a mutual correlation range, the mutual correlation range being between ±0.9; and (ii) the indicator has a performance value greater than or equal to a performance threshold representing the ability of the indicator to diagnose the presence, absence or degree of the at least one condition, or to provide a prognosis for the at least one condition, the performance threshold being indicative of an explained variance of at least 0.3, wherein at least one of the at least four IRS biomarkers is selected from a first IRS biomarker group, wherein at least one other of the at least four IRS biomarkers is selected from a second IRS biomarker group, wherein at least one other of the at least four IRS biomarkers is selected from a third IRS biomarker group, and wherein at least one other of the at least four IRS biomarkers is selected from a fourth IRS biomarker group, wherein the first IRS biomarker group consists of polynucleotide and/or polypeptide expression products from group G IRS biomarker genes as defined herein, wherein the second IRS biomarker group consists of polynucleotide and/or polypeptide expression products from group H IRS biomarker genes as defined herein, wherein the third IRS biomarker group consists of polynucleotide and/or polypeptide expression products from group I IRS biomarker genes as defined herein, and wherein the fourth IRS biomarker group consists of polynucleotide and/or polypeptide expression products from group J IRS biomarker genes as defined herein.

In still other embodiments, the methods, apparatus and kits are useful for diagnosing that mild sepsis or severe sepsis is present or absent in the biological subject, which suitably involve: (a) determining a plurality of IRS biomarker values, each IRS biomarker value being indicative of a value measured or derived for at least one IRS biomarker of a biological subject; (b) determining the indicator using a combination of the plurality of IRS biomarker values, the at least one indicator being at least partially indicative of the presence, absence, degree or prognosis of the at least one condition selected from mild sepsis and severe sepsis, wherein: (i) at least two IRS biomarkers have a mutual correlation in respect of the at least one condition that lies within a mutual correlation range, the mutual correlation range being between ±0.9; and (ii) the indicator has a performance value greater than or equal to a performance threshold representing the ability of the indicator to diagnose the presence, absence or degree of the at least one condition, or to provide a prognosis for the at least one condition, the performance threshold being indicative of an explained variance of at least 0.3, wherein at least one of the at least two IRS biomarkers is selected from a first IRS biomarker group and wherein at least one other of the at least two IRS biomarkers is selected from a second IRS biomarker group, wherein the first IRS biomarker group consists of polynucleotide and/or polypeptide expression products from group K IRS biomarker genes as defined herein, and wherein the second IRS biomarker group consists of polynucleotide and/or polypeptide expression products from group L IRS biomarker genes as defined herein.

In still other embodiments, the methods, apparatus and kits are useful for diagnosing that mild sepsis or septic shock is present or absent in the biological subject, which suitably involve: (a) determining a plurality of IRS biomarker values, each IRS biomarker value being indicative of a value measured or derived for at least one IRS biomarker of a biological subject; (b) determining the indicator using a combination of the plurality of IRS biomarker values, the at least one indicator being at least partially indicative of the presence, absence, degree or prognosis of the at least one condition selected from mild sepsis and septic shock, wherein: (i) at least two IRS biomarkers have a mutual correlation in respect of the at least one condition that lies within a mutual correlation range, the mutual correlation range being between ±0.9; and (ii) the indicator has a performance value greater than or equal to a performance threshold representing the ability of the indicator to diagnose the presence, absence or degree of the at least one condition, or to provide a prognosis for the at least one condition, the performance threshold being indicative of an explained variance of at least 0.3, wherein at least one of the at least two IRS biomarkers is selected from a first IRS biomarker group and wherein at least one other of the at least two IRS biomarkers is selected from a second IRS biomarker group, wherein the first IRS biomarker group consists of polynucleotide and/or polypeptide expression products from group M IRS biomarker genes as defined herein, and wherein the second IRS biomarker group consists of polynucleotide and/or polypeptide expression products from group N IRS biomarker genes as defined herein.

In still other embodiments, the methods, apparatus and kits are useful for diagnosing that severe sepsis or septic shock is present or absent in the biological subject, which suitably involve: (a) determining a plurality of IRS biomarker values, each IRS biomarker value being indicative of a value measured or derived for at least one IRS biomarker of a biological subject; (b) determining the indicator using a combination of the plurality of IRS biomarker values, the at least one indicator being at least partially indicative of the presence, absence, degree or prognosis of the at least one condition selected from severe sepsis and septic shock, wherein: (i) at least two IRS biomarkers have a mutual correlation in respect of the at least one condition that lies within a mutual correlation range, the mutual correlation range being between ±0.9; and (ii) the indicator has a performance value greater than or equal to a performance threshold representing the ability of the indicator to diagnose the presence, absence or degree of the at least one condition, or to provide a prognosis for the at least one condition, the performance threshold being indicative of an explained variance of at least 0.3, wherein at least one of the at least two IRS biomarkers is selected from a first IRS biomarker group and wherein at least one other of the at least two IRS biomarkers is selected from a second IRS biomarker group, wherein the first IRS biomarker group consists of polynucleotide and/or polypeptide expression products from group O IRS biomarker genes as defined herein, and wherein the second IRS biomarker group consists of polynucleotide and/or polypeptide expression products from group P IRS biomarker genes as defined herein.

As used herein, the terms "diagnosis", "diagnosing" and the like are used interchangeable herein to encompass determining the likelihood that a subject will develop a condition, or the existence or nature of a condition in a subject. These terms also encompass determining the severity of disease or episode of disease, as well as in the context of rational therapy, in which the diagnosis guides therapy, including initial selection of therapy, modification of therapy (e.g., adjustment of dose or dosage regimen), and the like. By "likelihood" is meant a measure of whether a biological subject with particular measured or derived biomarker values actually has a condition (or not) based on a given mathematical model. An increased likelihood for example may be relative or absolute and may be expressed qualitatively or quantitatively. For instance, an increased likelihood may be determined simply by determining the subject's measured or derived biomarker values for at least two IRS biomarkers and placing the subject in an "increased likelihood" category, based upon previous population studies. The term "likelihood" is also used interchangeably herein with the term "probability".

In some embodiments, the biomarkers, including IRS biomarkers, are obtained from a biological sample. The term "biological sample" as used herein refers to a sample that may be extracted, untreated, treated, diluted or concentrated from an animal. The biological sample is suitably a biological fluid such as whole blood, serum, plasma, saliva, urine, sweat, ascitic fluid, peritoneal fluid, synovial fluid, amniotic fluid, cerebrospinal fluid, tissue biopsy, and the like. In certain embodiments, the biological sample contains blood, especially peripheral blood, or a fraction or extract thereof. Typically, the biological sample comprises blood cells such as mature, immature or developing leukocytes, including lymphocytes, polymorphonuclear leukocytes, neutrophils, monocytes, reticulocytes, basophils, coelomocytes, hemocytes, eosinophils, megakaryocytes, macrophages, dendritic cells natural killer cells, or fraction of such cells (e.g., a nucleic acid or protein fraction). In specific embodiments, the biological sample comprises leukocytes including peripheral blood mononuclear cells (PBMC). By "obtained from" is meant to come into possession. Biological or reference samples so obtained include, for example, nucleic acid extracts or polypeptide extracts isolated or derived from a particular source. For instance, the extract may be isolated directly from a biological fluid or tissue of a subject.

The term "nucleic acid" or "polynucleotide" as used herein includes RNA, mRNA, miRNA, cRNA, cDNA mtDNA, or DNA. The term typically refers to a polymeric form of nucleotides of at least 10 bases in length, either ribonucleotides or deoxyribonucleotides or a modified form of either type of nucleotide. The term includes single and double stranded forms of DNA or RNA.

"Protein", "polypeptide" and "peptide" are used interchangeably herein to refer to a polymer of amino acid residues and to variants and synthetic analogues of the same.

In some embodiments, biomarker signatures are determined through analysis of measured or derived IRS biomarker values for IRS biomarkers of one or more control subjects that have or do not have a condition. These biomarkers are referred to herein as "reference IRS biomarkers". In specific examples, individual control subjects are selected from "healthy control subjects", "non-healthy control subjects", "SIRS control subjects", "inSIRS control subjects", "ipSIRS control subjects", "control subjects with a particular stage of ipSIRS", illustrative examples of which include "mild sepsis control subjects", "severe sepsis control subjects" and "septic shock control subjects", etc.), which are also referred to herein as control groups (e.g., "healthy control group", "non-healthy control group", "SIRS control group", "inSIRS control group", "ipSIRS control group", "ipSIRS stage group", illustrative examples of which include "mild sepsis control group", "severe sepsis control group", and "septic shock control group", etc.).

Suitably, an individual measured or derived IRS biomarker value corresponds to the level or amount of a respective IRS biomarker or to a function that is applied to that level or amount. As used herein the terms "level" and "amount" are used interchangeably herein to refer to a quantitative amount (e.g., weight or moles), a semi-quantitative amount, a relative amount (e.g., weight % or mole % within class), a concentration, and the like. Thus, these terms encompass absolute or relative amounts or concentrations of IRS biomarkers in a sample.

In some embodiments, the presence, absence, degree or prognosis of at least one condition in a biological subject is established by determining a plurality of IRS biomarker values, wherein each IRS biomarker value is indicative of a value measured or derived for at least one IRS biomarker in a biological sample obtained from the biological subject. These biomarkers are referred to herein as "sample IRS biomarkers". In accordance with the present invention, a sample IRS biomarker corresponds to a reference IRS biomarker (also referred to herein as a "corresponding IRS biomarker"). By "corresponding IRS biomarker" is meant an IRS biomarker that is structurally and/or functionally similar to a reference IRS biomarker. Representative corresponding IRS biomarkers include expression products of allelic variants (same locus), homologues (different locus), and orthologues (different organism) of reference IRS biomarker genes. Nucleic acid variants of reference IRS biomarker genes and encoded IRS biomarker polynucleotide expression products can contain nucleotide substitutions, deletions, inversions and/or insertions. Variation can occur in either or both the coding and non-coding regions. The variations can produce both conservative and non-conservative amino acid substitutions (as compared in the encoded product). For nucleotide sequences, conservative variants include those sequences that, because of the degeneracy of the genetic code, encode the amino acid sequence of a reference IRS polypeptide.

Generally, variants of a particular IRS biomarker gene or polynucleotide will have at least about 40%, 45%, 50%, 51%, 52%, 53%, 54%, 55%, 56%, 57%, 58%, 59% 60%, 61%, 62%, 63%, 64%, 65%, 66%, 67%, 68%, 69% 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or more sequence identity to that particular nucleotide sequence as determined by sequence alignment programs known in the art using default parameters. In some embodiments, the IRS biomarker gene or polynucleotide displays at least about 40%, 45%, 50%, 51%, 52%, 53%, 54%, 55%, 56%, 57%, 58%, 59% 60%, 61%, 62%, 63%, 64%, 65%, 66%, 67%, 68%, 69% 70%, 71%, 72%, 73%, 74%, 75%, 76%, 77%, 78%, 79%, 80%, 81%, 82%, 83%, 84%, 85%, 86%, 87%, 88%, 89%, 90%, 91%, 92%, 93%, 94%, 95%, 96%, 97%, 98%, 99% or more sequence identity to a nucleotide sequence selected from any one of SEQ ID NO: 1-1650, as summarized in Table 1.

Corresponding IRS biomarkers also include amino acid sequences that display substantial sequence similarity or identity to the amino acid sequence of a reference IRS biomarker polypeptide. In general, an amino acid sequence that corresponds to a reference amino acid sequence will display at least about 50, 51, 52, 53, 54, 55, 56, 57, 58, 59, 60, 61, 62, 63, 64, 65, 66, 67, 68, 69, 70, 71, 72, 73, 74, 75, 76, 77, 78, 79, 80, 81, 82, 83, 84, 85, 86, 97, 88, 89, 90, 91, 92, 93, 94, 95, 96, 97, 98, 99% or even up to 100% sequence similarity or identity to a reference amino acid sequence selected from any one of SEQ ID NO: 1651-3284, as summarized in Table 2.

In some embodiments, calculations of sequence similarity or sequence identity between sequences are performed as follows:

To determine the percentage identity of two amino acid sequences, or of two nucleic acid sequences, the sequences are aligned for optimal comparison purposes (e.g., gaps can be introduced in one or both of a first and a second amino acid or nucleic acid sequence for optimal alignment and non-homologous sequences can be disregarded for comparison purposes). In some embodiments, the length of a reference sequence aligned for comparison purposes is at least 30%, usually at least 40%, more usually at least 50%, 60%, and even more usually at least 70%, 80%, 90%, 100% of the length of the reference sequence. The amino acid residues or nucleotides at corresponding amino acid positions or nucleotide positions are then compared. When a position in the first sequence is occupied by the same amino acid residue or nucleotide at the corresponding position in the second sequence, then the molecules are identical at that position. For amino acid sequence comparison, when a position in the first sequence is occupied by the same or similar amino acid residue (i.e., conservative substitution) at the corresponding position in the second sequence, then the molecules are similar at that position.

The percentage identity between the two sequences is a function of the number of identical amino acid residues shared by the sequences at individual positions, taking into account the number of gaps, and the length of each gap, which need to be introduced for optimal alignment of the two sequences. By contrast, the percentage similarity between the two sequences is a function of the number of identical and similar amino acid residues shared by the sequences at individual positions, taking into account the number of gaps, and the length of each gap, which need to be introduced for optimal alignment of the two sequences.

The comparison of sequences and determination of percentage identity or percentage similarity between sequences can be accomplished using a mathematical algorithm. In certain embodiments, the percentage identity or similarity between amino acid sequences is determined using the Needleman and Wunsch, (1970, *J. Mol. Biol.* 48: 444-453) algorithm which has been incorporated into the GAP program in the GCG software package (available at http://www.gcg.com), using either a Blossum 62 matrix or a PAM250 matrix, and a gap weight of 16, 14, 12, 10, 8, 6, or 4 and a length weight of 1, 2, 3, 4, 5, or 6. In specific embodiments, the percent identity between nucleotide sequences is determined using the GAP program in the GCG software package (available at http://www.gcg.com), using a NWSgapdna.CMP matrix and a gap weight of 40, 50, 60, 70, or 80 and a length weight of 1, 2, 3, 4, 5, or 6. An non-limiting set of parameters (and the one that should be used unless otherwise specified) includes a Blossum 62 scoring matrix with a gap penalty of 12, a gap extend penalty of 4, and a frameshift gap penalty of 5.

In some embodiments, the percentage identity or similarity between amino acid or nucleotide sequences can be determined using the algorithm of E. Meyers and W. Miller (1989, *Cabios,* 4: 11-17) which has been incorporated into the ALIGN program (version 2.0), using a PAM120 weight residue table, a gap length penalty of 12 and a gap penalty of 4.

The nucleic acid and protein sequences described herein can be used as a "query sequence" to perform a search against public databases to, for example, identify other family members or related sequences. Such searches can be performed using the NBLAST and XBLAST programs (version 2.0) of Altschul, et al., (1990, *J Mol Biol.,* 215: 403-10). BLAST nucleotide searches can be performed with the NBLAST program, score=100, wordlength=12 to obtain nucleotide sequences homologous to 53010 nucleic acid molecules of the invention. BLAST protein searches can be performed with the XBLAST program, score=50, word-length=3 to obtain amino acid sequences homologous to YYYYY protein molecules of the invention. To obtain gapped alignments for comparison purposes, Gapped BLAST can be utilized as described in Altschul et al., (1997, *Nucleic Acids Res*, 25: 3389-3402). When utilizing BLAST and Gapped BLAST programs, the default parameters of the respective programs (e.g., XBLAST and NBLAST) can be used.

Corresponding IRS biomarker polynucleotides also include nucleic acid sequences that hybridize to reference IRS biomarker polynucleotides, or to their complements, under stringency conditions described below. As used herein, the term "hybridizes under low stringency, medium stringency, high stringency, or very high stringency conditions" describes conditions for hybridization and washing. "Hybridization" is used herein to denote the pairing of complementary nucleotide sequences to produce a DNA-DNA hybrid or a DNA-RNA hybrid. Complementary base sequences are those sequences that are related by the base-pairing rules. In DNA, A pairs with T and C pairs with G. In RNA, U pairs with A and C pairs with G. In this regard, the terms "match" and "mismatch" as used herein refer to the hybridization potential of paired nucleotides in complementary nucleic acid strands. Matched nucleotides hybridize efficiently, such as the classical A-T and G-C base pair mentioned above. Mismatches are other combinations of nucleotides that do not hybridize efficiently.

Guidance for performing hybridization reactions can be found in Ausubel et al., (1998, supra), Sections 6.3.1-6.3.6. Aqueous and non-aqueous methods are described in that reference and either can be used. Reference herein to low stringency conditions include and encompass from at least about 1% v/v to at least about 15% v/v formamide and from at least about 1 M to at least about 2 M salt for hybridization at 42° C., and at least about 1 M to at least about 2 M salt for washing at 42° C. Low stringency conditions also may include 1% Bovine Serum Albumin (BSA), 1 mM EDTA, 0.5 M NaHPO$_4$ (pH 7.2), 7% SDS for hybridization at 65° C., and (i) 2×SSC, 0.1% SDS; or (ii) 0.5% BSA, 1 mM EDTA, 40 mM NaHPO$_4$ (pH 7.2), 5% SDS for washing at room temperature. One embodiment of low stringency conditions includes hybridization in 6× sodium chloride/sodium citrate (SSC) at about 45° C., followed by two washes in 0.2×SSC, 0.1% SDS at least at 50° C. (the temperature of the washes can be increased to 55° C. for low stringency conditions). Medium stringency conditions include and encompass from at least about 16% v/v to at least about 30% v/v formamide and from at least about 0.5 M to at least about 0.9 M salt for hybridization at 42° C., and at least about 0.1 M to at least about 0.2 M salt for washing at 55° C. Medium stringency conditions also may include 1% Bovine Serum Albumin (BSA), 1 mM EDTA, 0.5 M NaHPO$_4$ (pH 7.2), 7% SDS for hybridization at 65° C., and (i) 2×SSC, 0.1% SDS; or (ii) 0.5% BSA, 1 mM EDTA, 40 mM NaHPO$_4$ (pH 7.2), 5% SDS for washing at 60-65° C. One embodiment of medium stringency conditions includes hybridizing in 6×SSC at about 45° C., followed by one or more washes in 0.2×SSC, 0.1% SDS at 60° C. High stringency conditions include and encompass from at least about 31% v/v to at least about 50% v/v formamide and from about 0.01 M to about 0.15 M salt for hybridization at 42° C., and about 0.01 M to about 0.02 M salt for washing at 55° C. High stringency conditions also may include 1% BSA, 1 mM EDTA, 0.5 M NaHPO$_4$ (pH 7.2), 7% SDS for hybridization at 65° C., and (i) 0.2×SSC, 0.1% SDS; or (ii) 0.5% BSA, 1 mM EDTA, 40 mM NaHPO$_4$ (pH 7.2), 1% SDS for washing at a temperature in excess of 65° C. One embodiment of high stringency conditions includes hybridizing in 6×SSC at about 45° C., followed by one or more washes in 0.2×SSC, 0.1% SDS at 65° C.

In certain embodiments, a corresponding IRS biomarker polynucleotide is one that hybridizes to a disclosed nucleotide sequence under very high stringency conditions. One embodiment of very high stringency conditions includes hybridizing 0.5 M sodium phosphate, 7% SDS at 65° C., followed by one or more washes at 0.2×SSC, 1% SDS at 65° C.

Other stringency conditions are well known in the art and a skilled addressee will recognize that various factors can be manipulated to optimize the specificity of the hybridization. Optimization of the stringency of the final washes can serve to ensure a high degree of hybridization. For detailed examples, see Ausubel et al., supra at pages 2.10.1 to 2.10.16 and Sambrook et al. (1989, supra) at sections 1.101 to 1.104.

The IRS biomarkers disclosed herein each have significant sensitivity and specificity for diagnosing the presence, absence or degree of at least condition selected from a healthy condition (e.g., a normal condition or one in which inSIRS and inSIRS are absent), inSIRS, ipSIRS or a stage of ipSIRS (e.g., a stage of ipSIRS with a particular severity such as mild sepsis, severe sepsis and septic shock). Accordingly, it is feasible to use individual IRS biomarkers in methods, apparatus and kits that do not rely on the use of low mutual correlation between biomarkers to diagnose the presence, absence or degree of the at least condition. In illustrative examples of this type, the invention contemplates methods, kits and apparatus that are useful for diagnosing that inSIRS or a healthy condition is present or absent in a biological subject, which suitably involve: (1) correlating a reference biomarker signature with the presence or absence of a condition selected from inSIRS and a healthy condition, wherein the reference biomarker signature evaluates at least one IRS biomarker; (2) obtaining a biomarker signature of a sample from a subject, wherein the sample biomarker signature evaluates for an individual IRS biomarker in the reference biomarker signature a corresponding IRS biomarker; and (3) diagnosing the presence or absence of the condition in the subject based on the sample biomarker signature and the reference biomarker signature, wherein an individual IRS biomarker is an expression product of an IRS biomarker gene selected from the group A and group B IRS biomarker genes as defined herein.

In other non-limiting examples, the methods, apparatus and kits are useful for diagnosing that ipSIRS or a healthy condition is present or absent in the biological subject, which suitably involve: (1) correlating a reference biomarker signature with the presence or absence of a condition selected from ipSIRS and a healthy condition, wherein the reference biomarker signature evaluates at least one IRS biomarker; (2) obtaining a biomarker signature of a sample from a subject, wherein the sample biomarker signature evaluates for an individual IRS biomarker in the reference biomarker signature a corresponding IRS biomarker; and (3) diagnosing the presence or absence of the condition in the subject based on the sample biomarker signature and the reference biomarker signature, wherein an individual IRS biomarker is an expression product of an IRS biomarker gene selected from the group C and group D IRS biomarker genes as defined herein.

In still other non-limiting examples, the methods, apparatus and kits are useful for diagnosing that inSIRS or ipSIRS is present or absent in the biological subject, which suitably involve: (1) correlating a reference biomarker signature with the presence or absence of a condition selected from inSIRS and ipSIRS, wherein the reference biomarker signature evaluates at least one IRS biomarker; (2) obtaining a biomarker signature of a sample from a subject, wherein the sample biomarker signature evaluates for an individual IRS biomarker in the reference biomarker signature a corresponding IRS biomarker; and (3) diagnosing the presence or absence of the condition in the subject based on the sample biomarker signature and the reference biomarker signature, wherein an individual IRS biomarker is an expression product of an IRS biomarker gene selected from the group E and group F IRS biomarker genes as defined herein.

In still other illustrative examples, the methods, apparatus and kits are useful for diagnosing that mild sepsis or severe sepsis is present or absent in the biological subject, which suitably involve: (1) correlating a reference biomarker signature with the presence or absence of a condition selected from mild sepsis and severe sepsis, wherein the reference biomarker signature evaluates at least one IRS biomarker; (2) obtaining a biomarker signature of a sample from a subject, wherein the sample biomarker signature evaluates for an individual IRS biomarker in the reference biomarker signature a corresponding IRS biomarker; and (3) diagnosing the presence or absence of the condition in the subject based on the sample biomarker signature and the reference biomarker signature, wherein an individual IRS biomarker is an expression product of an IRS biomarker gene selected from the group K and group L IRS biomarker genes as defined herein.

In still other illustrative examples, the methods, apparatus and kits are useful for diagnosing that mild sepsis or septic shock is present or absent in the biological subject, which suitably involve: (1) correlating a reference biomarker signature with the presence or absence of a condition selected from mild sepsis and septic shock, wherein the reference biomarker signature evaluates at least one IRS biomarker; (2) obtaining a biomarker signature of a sample from a subject, wherein the sample biomarker signature evaluates for an individual IRS biomarker in the reference biomarker signature a corresponding IRS biomarker; and (3) diagnosing the presence or absence of the condition in the subject based on the sample biomarker signature and the reference biomarker signature, wherein an individual IRS biomarker is an expression product of an IRS biomarker gene selected from the group M and group N IRS biomarker genes as defined herein.

In other non-limiting examples, the methods, apparatus and kits are useful for diagnosing that severe sepsis or septic shock is present or absent in the biological subject, which suitably involve: (1) correlating a reference biomarker signature with the presence or absence of a condition selected from severe sepsis and septic shock, wherein the reference biomarker signature evaluates at least one IRS biomarker; (2) obtaining a biomarker signature of a sample from a subject, wherein the sample biomarker signature evaluates for an individual IRS biomarker in the reference biomarker signature a corresponding IRS biomarker; and (3) diagnosing the presence or absence of the condition in the subject based on the sample biomarker signature and the reference biomarker signature, wherein an individual IRS biomarker is an expression product of an IRS biomarker gene selected from the group O and group P IRS biomarker genes as defined herein.

The biomarkers may be quantified or detected using any suitable technique. In specific embodiments, the biomarkers, including the IRS biomarkers, are quantified using reagents that determine the level or abundance of individual biomarkers. Non-limiting reagents of this type include reagents for use in nucleic acid- and protein-based assays.

In illustrative nucleic acid-based assays, nucleic acid is isolated from cells contained in the biological sample according to standard methodologies (Sambrook, et al., 1989, supra; and Ausubel et al., 1994, supra). The nucleic acid is typically fractionated (e.g., poly $A^+$ RNA) or whole cell RNA. Where RNA is used as the subject of detection, it may be desired to convert the RNA to a complementary DNA. In some embodiments, the nucleic acid is amplified by a template-dependent nucleic acid amplification technique. A number of template dependent processes are available to amplify the IRS biomarker sequences present in a given template sample. An exemplary nucleic acid amplification technique is the polymerase chain reaction (referred to as PCR), which is described in detail in U.S. Pat. Nos. 4,683,195, 4,683,202 and 4,800,159, Ausubel et al. (supra), and in Innis et al., ("PCR Protocols", Academic Press, Inc., San Diego Calif., 1990). Briefly, in PCR, two primer sequences are prepared that are complementary to regions on opposite complementary strands of the biomarker sequence. An excess of deoxynucleotide triphosphates are added to a reaction mixture along with a DNA polymerase, e.g., Taq polymerase. If a cognate IRS biomarker sequence is present in a sample, the primers will bind to the biomarker and the polymerase will cause the primers to be extended along the biomarker sequence by adding on nucleotides. By raising and lowering the temperature of the reaction mixture, the extended primers will dissociate from the biomarker to form reaction products, excess primers will bind to the biomarker and to the reaction products and the process is repeated. A reverse transcriptase PCR amplification procedure may be performed in order to quantify the amount of mRNA amplified. Methods of reverse transcribing RNA into cDNA are well known and described in Sambrook et al., 1989, supra. Alternative methods for reverse transcription utilize thermostable, RNA-dependent DNA polymerases. These methods are described in WO 90/07641. Polymerase chain reaction methodologies are well known in the art.

In certain advantageous embodiments, the template-dependent amplification involves quantification of transcripts in real-time. For example, RNA or DNA may be quantified using the Real-Time PCR technique (Higuchi, 1992, et al., *Biotechnology* 10: 413-417). By determining the concentration of the amplified products of the target DNA in PCR reactions that have completed the same number of cycles and are in their linear ranges, it is possible to determine the relative concentrations of the specific target sequence in the original DNA mixture. If the DNA mixtures are cDNAs synthesized from RNAs isolated from different tissues or cells, the relative abundance of the specific mRNA from which the target sequence was derived can be determined for the respective tissues or cells. This direct proportionality between the concentration of the PCR products and the relative mRNA abundance is only true in the linear range of the PCR reaction. The final concentration of the target DNA in the plateau portion of the curve is determined by the availability of reagents in the reaction mix and is independent of the original concentration of target DNA. In specific embodiments, multiplexed, tandem PCR (MT-PCR) is employed, which uses a two-step process for gene expression profiling from small quantities of RNA or DNA, as described for example in US Pat. Appl. Pub. No. 20070190540. In the first step, RNA is converted into cDNA and amplified using multiplexed gene specific primers. In the second step each individual gene is quantitated by real time PCR.

In certain embodiments, target nucleic acids are quantified using blotting techniques, which are well known to those of skill in the art. Southern blotting involves the use of DNA as a target, whereas Northern blotting involves the use of RNA as a target. Each provides different types of information, although cDNA blotting is analogous, in many aspects, to blotting or RNA species. Briefly, a probe is used to target a DNA or RNA species that has been immobilized on a suitable matrix, often a filter of nitrocellulose. The different species should be spatially separated to facilitate analysis. This often is accomplished by gel electrophoresis of nucleic acid species followed by "blotting" on to the filter. Subsequently, the blotted target is incubated with a probe (usually labeled) under conditions that promote denaturation and rehybridization. Because the probe is designed to base pair with the target, the probe will bind a portion of the target sequence under renaturing conditions. Unbound probe is then removed, and detection is accomplished as described above. Following detection/quantification, one may compare the results seen in a given subject with a control reaction or a statistically significant reference group or population of control subjects as defined herein. In this way, it is possible to correlate the amount of an IRS biomarker nucleic acid detected with the progression or severity of the disease. As used herein, the term "probe" refers to a molecule that binds to a specific sequence or sub-sequence or other moiety of another molecule. Unless otherwise indicated, the term "probe" typically refers to a nucleic acid probe that binds to another nucleic acid, also referred to herein as a "target polynucleotide", through complementary base pairing. Probes can bind target polynucleotides lacking complete sequence complementarity with the probe, depending on the stringency of the hybridization conditions. Probes can be labeled directly or indirectly and include primers within their scope. By "primer" is meant an oligonucleotide which, when paired with a strand of DNA, is capable of initiating the synthesis of a primer extension product in the presence of a suitable polymerizing agent. The primer is preferably single-stranded for maximum efficiency in amplification but can alternatively be double-stranded. A primer must be sufficiently long to prime the synthesis of extension products in the presence of the polymerization agent. The length of the primer depends on many factors, including application, temperature to be employed, template reaction conditions, other reagents, and source of primers. For example, depending on the complexity of the target sequence, the primer may be at least about 5, 6, 7, 8, 9, 10, 11, 12, 13, 14, 15, 16, 17, 18, 19, 20, 21, 22, 23, 24, 25, 26, 27, 28, 29, 30, 35, 40, 50, 75, 100, 150, 200, 300, 400, 500, to one base shorter in length than the template sequence at the 3' end of the primer to allow extension of a nucleic acid chain, though the 5' end of the primer may extend in length beyond the 3' end of the template sequence. In certain embodiments, primers can be large polynucleotides, such as from about 35 nucleotides to several kilobases or more. Primers can be selected to be "substantially complementary" to the sequence on the template to which it is designed to hybridize and serve as a site for the initiation of synthesis. By "substantially complementary", it is meant that the primer is sufficiently complementary to hybridize with a target polynucleotide. Desirably, the primer contains no mismatches with the template to which it is designed to hybridize but this is not essential. For example, non-complementary nucleotide residues can be attached to the 5' end of the primer, with the remainder of the primer sequence being complementary to the template. Alternatively, non-complementary nucleotide residues or a stretch of non-complementary nucleotide residues can be interspersed into a primer, provided that the primer sequence has sufficient complementarity with the sequence of the template to hybridize therewith and thereby form a template for synthesis of the extension product of the primer.

Also contemplated are biochip-based technologies such as those described by Hacia et al. (1996, *Nature Genetics* 14: 441-447) and Shoemaker et al. (1996, *Nature Genetics* 14: 450-456). Briefly, these techniques involve quantitative methods for analyzing large numbers of genes rapidly and accurately. By tagging genes with oligonucleotides or using fixed nucleic acid probe arrays, one can employ biochip technology to segregate target molecules as high-density arrays and screen these molecules on the basis of hybridization. See also Pease et al. (1994, *Proc. Natl. Acad. Sci. U.S.A.* 91: 5022-5026); Fodor et al. (1991, *Science* 251: 767-773). Briefly, nucleic acid probes to IRS biomarker polynucleotides are made and attached to biochips to be used in screening and diagnostic methods, as outlined herein. The nucleic acid probes attached to the biochip are designed to be substantially complementary to specific expressed IRS biomarker nucleic acids, i.e., the target sequence (either the target sequence of the sample or to other probe sequences, for example in sandwich assays), such that hybridization of the target sequence and the probes of the present invention occur. This complementarity need not be perfect; there may be any number of base pair mismatches, which will interfere with hybridization between the target sequence and the nucleic acid probes of the present invention. However, if the number of mismatches is so great that no hybridization can occur under even the least stringent of hybridization conditions, the sequence is not a complementary target sequence. In certain embodiments, more than one probe per sequence is used, with either overlapping probes or probes to different sections of the target being used. That is, two, three, four or more probes, with three being desirable, are used to build in a redundancy for a particular target. The probes can be overlapping (i.e. have some sequence in common), or separate.

In an illustrative biochip analysis, oligonucleotide probes on the biochip are exposed to or contacted with a nucleic acid sample suspected of containing one or more IRS biomarker polynucleotides under conditions favoring specific hybridization. Sample extracts of DNA or RNA, either single or double-stranded, may be prepared from fluid suspensions of biological materials, or by grinding biological materials, or following a cell lysis step which includes, but is not limited to, lysis effected by treatment with SDS (or other detergents), osmotic shock, guanidinium isothiocyanate and lysozyme. Suitable DNA, which may be used in the method of the invention, includes cDNA. Such DNA may be prepared by any one of a number of commonly used protocols as for example described in Ausubel, et al., 1994, supra, and Sambrook, et al., 1989, supra.

Suitable RNA, which may be used in the method of the invention, includes messenger RNA, complementary RNA transcribed from DNA (cRNA) or genomic or subgenomic RNA. Such RNA may be prepared using standard protocols as for example described in the relevant sections of Ausubel, et al. 1994, supra and Sambrook, et al. 1989, supra).

cDNA may be fragmented, for example, by sonication or by treatment with restriction endonucleases. Suitably, cDNA is fragmented such that resultant DNA fragments are of a length greater than the length of the immobilized oligonucleotide probe(s) but small enough to allow rapid access thereto under suitable hybridization conditions. Alternatively, fragments of cDNA may be selected and amplified using a suitable nucleotide amplification technique, as described for example above, involving appropriate random or specific primers.

Usually the target IRS biomarker polynucleotides are detectably labeled so that their hybridization to individual probes can be determined. The target polynucleotides are typically detectably labeled with a reporter molecule illustrative examples of which include chromogens, catalysts, enzymes, fluorochromes, chemiluminescent molecules, bioluminescent molecules, lanthanide ions (e.g., $Eu^{34}$), a radioisotope and a direct visual label. In the case of a direct visual label, use may be made of a colloidal metallic or non-metallic particle, a dye particle, an enzyme or a substrate, an organic polymer, a latex particle, a liposome, or other vesicle containing a signal producing substance and the like. Illustrative labels of this type include large colloids, for example, metal colloids such as those from gold, selenium, silver, tin and titanium oxide. In some embodiments in which an enzyme is used as a direct visual label, biotinylated bases are incorporated into a target polynucleotide.

The hybrid-forming step can be performed under suitable conditions for hybridizing oligonucleotide probes to test nucleic acid including DNA or RNA. In this regard, reference may be made, for example, to NUCLEIC ACID HYBRIDIZATION, A PRACTICAL APPROACH (Homes and Higgins, eds.) (IRL press, Washington D.C., 1985). In general, whether hybridization takes place is influenced by the length of the oligonucleotide probe and the polynucleotide sequence under test, the pH, the temperature, the concentration of mono- and divalent cations, the proportion of G and C nucleotides in the hybrid-forming region, the viscosity of the medium and the possible presence of denaturants. Such variables also influence the time required for hybridization. The preferred conditions will therefore depend upon the particular application. Such empirical conditions, however, can be routinely determined without undue experimentation.

After the hybrid-forming step, the probes are washed to remove any unbound nucleic acid with a hybridization buffer. This washing step leaves only bound target polynucleotides. The probes are then examined to identify which probes have hybridized to a target polynucleotide.

The hybridization reactions are then detected to determine which of the probes has hybridized to a corresponding target sequence. Depending on the nature of the reporter molecule associated with a target polynucleotide, a signal may be instrumentally detected by irradiating a fluorescent label with light and detecting fluorescence in a fluorimeter; by providing for an enzyme system to produce a dye which could be detected using a spectrophotometer; or detection of a dye particle or a colored colloidal metallic or non-metallic particle using a reflectometer; in the case of using a radioactive label or chemiluminescent molecule employing a radiation counter or autoradiography. Accordingly, a detection means may be adapted to detect or scan light associated with the label which light may include fluorescent, luminescent, focused beam or laser light. In such a case, a charge couple device (CCD) or a photocell can be used to scan for emission of light from a probe:target polynucleotide hybrid from each location in the micro-array and record the data directly in a digital computer. In some cases, electronic detection of the signal may not be necessary. For example, with enzymatically generated color spots associated with nucleic acid array format, visual examination of the array will allow interpretation of the pattern on the array. In the case of a nucleic acid array, the detection means is suitably interfaced with pattern recognition software to convert the pattern of signals from the array into a plain language genetic profile. In certain embodiments, oligonucleotide probes specific for different IRS biomarker polynucleotides are in the form of a nucleic acid array and detection of a signal generated from a reporter molecule on the array is performed using a 'chip reader'. A detection system that can be used by a 'chip reader' is described for example by Pirrung et al. (U.S. Pat. No. 5,143,854). The chip reader will typically also incorporate some signal processing to determine whether the signal at a particular array position or feature is a true positive or maybe a spurious signal. Exemplary chip readers are described for example by Fodor et al. (U.S. Pat. No. 5,925,525). Alternatively, when the array is made using a mixture of individually addressable kinds of labeled microbeads, the reaction may be detected using flow cytometry.

In certain embodiments, the IRS biomarker is a target RNA (e.g., mRNA) or a DNA copy of the target RNA whose level is measured using at least one nucleic acid probe that hybridizes under at least low, medium, or high stringency conditions to the target RNA or to the DNA copy, wherein the nucleic acid probe comprises at least 15 (e.g., 15, 16, 17, 18, 19, 20, 21, 22, 23, 24, 25, 26, 27, 28, 29, 30, or more) contiguous nucleotides of an IRS biomarker polynucleotide. In some embodiments, the measured level or abundance of the target RNA or its DNA copy is normalized to the level or abundance of a reference RNA or a DNA copy of the reference RNA. Suitably, the nucleic acid probe is immobilized on a solid or semi-solid support. In illustrative examples of this type, the nucleic acid probe forms part of a spatial array of nucleic acid probes. In some embodiments, the level of nucleic acid probe that is bound to the target RNA or to the DNA copy is measured by hybridization (e.g., using a nucleic acid array). In other embodiments, the level of nucleic acid probe that is bound to the target RNA or to the DNA copy is measured by nucleic acid amplification (e.g., using a polymerase chain reaction (PCR)). In still other embodiments, the level of nucleic acid probe that is bound to the target RNA or to the DNA copy is measured by nuclease protection assay.

In other embodiments, IRS biomarker protein levels are assayed using protein-based assays known in the art. For example, when an IRS biomarker protein is an enzyme, the protein can be quantified based upon its catalytic activity or based upon the number of molecules of the protein contained in a sample. Antibody-based techniques may be employed including, for example, immunoassays, such as the enzyme-linked immunosorbent assay (ELISA) and the radioimmunoassay (RIA).

In specific embodiments, protein-capture arrays that permit simultaneous detection and/or quantification of a large number of proteins are employed. For example, low-density protein arrays on filter membranes, such as the universal protein array system (Ge, 2000 *Nucleic Acids Res.* 28(2):e3) allow imaging of arrayed antigens using standard ELISA techniques and a scanning charge-coupled device (CCD) detector Immuno-sensor arrays have also been developed that enable the simultaneous detection of clinical analytes. It is now possible using protein arrays, to profile protein expression in bodily fluids, such as in sera of healthy or diseased subjects, as well as in subjects pre- and post-drug treatment.

Exemplary protein capture arrays include arrays comprising spatially addressed antigen-binding molecules, commonly referred to as antibody arrays, which can facilitate extensive parallel analysis of numerous proteins defining a proteome or subproteome. Antibody arrays have been shown to have the required properties of specificity and acceptable background, and some are available commercially (e.g., BD Biosciences, Clontech, Bio-Rad and Sigma). Various methods for the preparation of antibody arrays have been reported (see, e.g., Lopez et al., 2003 *J. Chromatogram. B* 787:19-27; Cahill, 2000 *Trends in Biotechnology* 7:47-51; U.S. Pat. App. Pub. 2002/0055186; U.S. Pat. App. Pub. 2003/0003599; PCT publication WO 03/062444; PCT publication WO 03/077851; PCT publication WO 02/59601; PCT publication WO 02/39120; PCT publication WO 01/79849; PCT publication WO 99/39210). The antigen-binding molecules of such arrays may recognize at least a subset of proteins expressed by a cell or population of cells, illustrative examples of which include growth factor receptors, hormone receptors, neurotransmitter receptors, catecholamine receptors, amino acid derivative receptors, cytokine receptors, extracellular matrix receptors, antibodies, lectins, cytokines, serpins, proteases, kinases, phosphatases, ras-like GTPases, hydrolases, steroid hormone receptors, transcription factors, heat-shock transcription factors, DNA-binding proteins, zinc-finger proteins, leucine-zipper proteins, homeodomain proteins, intracellular signal transduction modulators and effectors, apoptosis-related factors, DNA synthesis factors, DNA repair factors, DNA recombination factors and cell-surface antigens.

Individual spatially distinct protein-capture agents are typically attached to a support surface, which is generally planar or contoured. Common physical supports include glass slides, silicon, microwells, nitrocellulose or PVDF membranes, and magnetic and other microbeads.

Particles in suspension can also be used as the basis of arrays, providing they are coded for identification; systems include color coding for microbeads (e.g., available from Luminex, Bio-Rad and Nanomics Biosystems) and semiconductor nanocrystals (e.g., QDots™, available from Quantum Dots), and barcoding for beads (UltraPlex™, available from Smartbeads) and multimetal microrods (Nanobarcodes™ particles, available from Surromed). Beads can also be assembled into planar arrays on semiconductor chips (e.g., available from LEAPS technology and BioArray Solutions). Where particles are used, individual protein-capture agents are typically attached to an individual particle to provide the spatial definition or separation of the array. The particles may then be assayed separately, but in parallel, in a compartmentalized way, for example in the wells of a microtiter plate or in separate test tubes.

In operation, a protein sample, which is optionally fragmented to form peptide fragments (see, e.g., U.S. Pat. App. Pub. 2002/0055186), is delivered to a protein-capture array under conditions suitable for protein or peptide binding, and the array is washed to remove unbound or non-specifically bound components of the sample from the array. Next, the presence or amount of protein or peptide bound to each feature of the array is detected using a suitable detection system. The amount of protein bound to a feature of the array may be determined relative to the amount of a second protein bound to a second feature of the array. In certain embodiments, the amount of the second protein in the sample is already known or known to be invariant.

In specific embodiments, the IRS biomarker is a target polypeptide whose level is measured using at least one antigen-binding molecule that is immuno-interactive with the target polypeptide. In these embodiments, the measured level of the target polypeptide is normalized to the level of a reference polypeptide. Suitably, the antigen-binding molecule is immobilized on a solid or semi-solid support. In illustrative examples of this type, the antigen-binding molecule forms part of a spatial array of antigen-binding molecule. In some embodiments, the level of antigen-binding molecule that is bound to the target polypeptide is measured by immunoassay (e.g., using an ELISA). Reference herein to "immuno-interactive" includes reference to any interaction, reaction, or other form of association between molecules and in particular where one of the molecules is, or mimics, a component of the immune system.

All the essential reagents required for detecting and quantifying the biomarkers of the invention, including IRS biomarkers, may be assembled together in a kit. In some embodiments, the kit comprises: (i) a reagent that allows quantification (e.g., determining the level or abundance) of a first biomarker; and (ii) a reagent that allows quantification (e.g., determining the level or abundance) of a second biomarker, wherein the first and second biomarkers have a mutual correlation in respect of at least one condition (e.g., at least one of a healthy condition and one or more diseases such as but not limited to inSIRS, ipSIRS or a stage of ipSIRS (e.g., a stage of ipSIRS with a particular severity such as mild sepsis, severe sepsis and septic shock)) that lies within a mutual correlation range of between ±0.9, and wherein a combination of respective biomarker values for the first and second biomarkers that are measured for or derived from a biological subject has a performance value greater than or equal to a performance threshold representing the ability of the combination of the first and second biomarkers to diagnose the presence, absence or degree of the at least one condition, or to provide a prognosis for the at least one condition, the performance threshold being a variance explained of at least 0.3. In some embodiments, the kit further comprises (iii) a reagent that allows quantification (e.g., determining the level or abundance) of a third biomarker; and (iv) a reagent that allows quantification (e.g., determining the level or abundance) of a fourth biomarker, wherein the third and fourth biomarkers have a mutual correlation in respect of the at least one condition that lies within a mutual correlation range of between ±0.9, and wherein a combination of respective biomarker values for the third and fourth biomarkers that are measured for or derived from a biological subject has a performance value greater than or equal to a performance threshold representing the ability of the combination of the third and fourth biomarkers to diagnose the presence, absence or degree of the at least one condition, or to provide a prognosis for the at least one condition, the performance threshold being a variance explained of at least 0.3.

In advantageous embodiments, the kits of the present invention are useful for diagnosing the presence, absence or degree of at least one condition, or for providing a prognosis for at least one condition, wherein the at least one condition is selected from a healthy condition, inSIRS, ipSIRS or a stage of ipSIRS. In these embodiments, IRS biomarkers are suitably selected from a group as broadly described above and elsewhere herein.

In the context of the present invention, "kit" is understood to mean a product containing the different reagents necessary for carrying out the methods of the invention packed so as to allow their transport and storage. Materials suitable for packing the components of the kit include crystal, plastic (polyethylene, polypropylene, polycarbonate and the like), bottles, vials, paper, envelopes and the like. Additionally, the kits of the invention can contain instructions for the simultaneous, sequential or separate use of the different components contained in the kit. The instructions can be in the form of printed material or in the form of an electronic support capable of storing instructions such that they can be read by a subject, such as electronic storage media (magnetic disks, tapes and the like), optical media (CD-ROM, DVD) and the like. Alternatively or in addition, the media can contain Internet addresses that provide the instructions.

A "reagent that allows quantification of a biomarker" means a compound or material, or set of compounds or materials, which allow quantification of the biomarker. In specific embodiments, the compound, material or set of compounds or materials permit determining the expression level of a gene (e.g., an IRS biomarker gene), including without limitation the extraction of RNA material, the determination of the level of a corresponding RNA, etc., primers for the synthesis of a corresponding cDNA, primers for amplification of DNA, and/or probes capable of specifically hybridizing with the RNAs (or the corresponding cDNAs) encoded by the genes, TaqMan probes, etc.

The kits may also optionally include appropriate reagents for detection of labels, positive and negative controls, washing solutions, blotting membranes, microtiter plates, dilution buffers and the like. For example, a nucleic acid-based detection kit may include (i) a biomarker polynucleotide (e.g., an IRS biomarker polynucleotide) (which may be used as a positive control), (ii) a primer or probe that specifically hybridizes to a biomarker polynucleotide (e.g., an IRS biomarker polynucleotide). Also included may be enzymes suitable for amplifying nucleic acids including various polymerases (reverse transcriptase, Taq, Sequenase™, DNA ligase etc. depending on the nucleic acid amplification technique employed), deoxynucleotides and buffers to provide the necessary reaction mixture for amplification. Such kits also generally will comprise, in suitable means, distinct containers for each individual reagent and enzyme as well as for each primer or probe. Alternatively, a protein-based detection kit may include (i) a biomarker polypeptide (e.g., an IRS biomarker polypeptide) (which may be used as a positive control), (ii) an antibody that binds specifically to a biomarker polypeptide (e.g., an IRS biomarker polypeptide). The kit can also feature various devices (e.g., one or more) and reagents (e.g., one or more) for performing one of the assays described herein; and/or printed instructions for using the kit to quantify the expression of a biomarker gene (e.g., an IRS biomarker gene).

The reagents described herein, which may be optionally associated with detectable labels, can be presented in the format of a microfluidics card, a chip or chamber, a microarray or a kit adapted for use with the assays described in the examples or below, e.g., RT-PCR or Q PCR techniques described herein. The term "microarray" refers to an arrangement of hybridizable array elements, e.g., probes (including primers), ligands, biomarker nucleic acid sequence or protein sequences on a substrate.

The reagents also have utility in compositions for detecting and quantifying the biomarkers of the invention. For example, a reverse transcriptase may be used to reverse transcribe RNA transcripts, including mRNA, in a nucleic acid sample, to produce reverse transcribed transcripts, including reverse transcribed mRNA (also referred to as "cDNA"). The nucleic acid sample is suitably derived from components of the immune system, representative examples of which include components of the innate and adaptive immune systems as broadly discussed for example above. In specific embodiments, the reverse transcribed RNA is derived blood cells (e.g., peripheral blood cells). Suitably, the reverse transcribed RNA is derived leukocytes.

The reagents are suitably used to quantify the reverse transcribed transcripts. For example, oligonucleotide primers that hybridize to the reverse transcribed transcript can be used to amplify at least a portion of the reverse transcribed transcript via a suitable nucleic acid amplification technique, e.g., RT-PCR or Q PCR techniques described herein. Alternatively, oligonucleotide probes may be used to hybridize to the reverse transcribed transcript for the quantification, using a nucleic acid hybridization analysis technique (e.g., microarray analysis), as described for example above. Thus, in some embodiments, a respective oligonucleotide primer or probe is hybridized to a complementary nucleic acid sequence of a reverse transcribed transcript in the compositions of the invention. The compositions typically comprise labeled reagents for detecting and/or quantifying the reverse transcribed transcripts. Representative reagents of this type include labeled oligonucleotide primers or probes that hybridize to RNA transcripts or reverse transcribed RNA, labeled RNA, labeled reverse transcribed RNA as well as labeled oligonucleotide linkers or tags (e.g., a labeled RNA or DNA linker or tag) for labeling (e.g., end labeling such as 3' end labeling) RNA or reverse transcribed RNA. The primers, probes, RNA or reverse transcribed RNA (i.e., cDNA) (whether labeled or non-labeled) may be immobilized or free in solution. Representative reagents of this type include labeled oligonucleotide primers or probes that hybridize to reverse transcribed and transcripts as well as labeled reverse transcribed transcripts. The label can be any reporter molecule as known in the art, illustrative examples of which are described above and elsewhere herein.

The present invention also encompasses non-reverse transcribed RNA embodiments in which cDNA is not made and the RNA transcripts are directly the subject of the analysis. Thus, in other embodiments, reagents are suitably used to quantify RNA transcripts directly. For example, oligonucleotide probes can be used to hybridize to transcripts for quantification of immune system biomarkers of the invention, using a nucleic acid hybridization analysis technique (e.g., microarray analysis), as described for example above. Thus, in some embodiments, a respective oligonucleotide probe is hybridized to a complementary nucleic acid sequence of an immune system biomarker transcript in the compositions of the invention. In illustrative examples of this type, the compositions may comprise labeled reagents that hybridize to transcripts for detecting and/or quantifying the transcripts. Representative reagents of this type include labeled oligonucleotide probes that hybridize to transcripts as well as labeled transcripts. The primers or probes may be immobilized or free in solution.

The term "immobilized" means that a molecular species of interest is fixed to a solid support, suitably by covalent linkage. This covalent linkage can be achieved by different means depending on the molecular nature of the molecular species. Moreover, the molecular species may be also fixed on the solid support by electrostatic forces, hydrophobic or hydrophilic interactions or Van-der-Waals forces. The above described physico-chemical interactions typically occur in interactions between molecules. In particular embodiments, all that is required is that the molecules (e.g., nucleic acids or polypeptides) remain immobilized or attached to a support under conditions in which it is intended to use the support, for example in applications requiring nucleic acid amplification and/or sequencing or in antibody-binding assays. For example, oligonucleotides or primers are immobilized such that a 3' end is available for enzymatic extension and/or at least a portion of the sequence is capable of hybridizing to a complementary sequence. In some embodiments, immobilization can occur via hybridization to a surface attached primer, in which case the immobilized primer or oligonucleotide may be in the 3'-5' orientation. In other embodiments, immobilization can occur by means other than base-pairing hybridization, such as the covalent attachment.

The term "solid support" as used herein refers to a solid inert surface or body to which a molecular species, such as a nucleic acid and polypeptides can be immobilized. Non-limiting examples of solid supports include glass surfaces, plastic surfaces, latex, dextran, polystyrene surfaces, polypropylene surfaces, polyacrylamide gels, gold surfaces, and silicon wafers. In some embodiments, the solid supports are in the form of membranes, chips or particles. For example, the solid support may be a glass surface (e.g., a planar surface of a flow cell channel). In some embodiments, the solid support may comprise an inert substrate or matrix which has been "functionalized", such as by applying a layer or coating of an intermediate material comprising reactive groups which permit covalent attachment to molecules such as polynucleotides. By way of non-limiting example, such supports can include polyacrylamide hydrogels supported on an inert substrate such as glass. The molecules (e.g., polynucleotides) can be directly covalently attached to the intermediate material (e.g., a hydrogel) but the intermediate material can itself be non-covalently attached to the substrate or matrix (e.g., a glass substrate). The support can include a plurality of particles or beads each having a different attached molecular species.

The present invention also extends to the management of inSIRS, ipSIRS or particular stages of ipSIRS, or prevention of further progression of inSIRS, ipSIRS or particular stages of ipSIRS (e.g., mild sepsis, severe sepsis and septic shock), or assessment of the efficacy of therapies in subjects following positive diagnosis for the presence of inSIRS, ipSIRS or particular stage of ipSIRS (e.g., mild sepsis, severe sepsis and septic shock) in a subject. The management of inSIRS or ipSIRS conditions is generally highly intensive and can include identification and amelioration of the underlying cause and aggressive use of therapeutic compounds such as, vasoactive compounds, antibiotics, steroids, antibodies to endotoxin, anti-tumor necrosis factor agents, recombinant protein C. In addition, palliative therapies as described for example in Cohen and Glauser (1991, Lancet 338: 736-739) aimed at restoring and protecting organ function can be used such as intravenous fluids and oxygen and tight glycemic control. Therapies for ipSIRS are reviewed in Healy (2002, Ann Pharmacother. 36(4): 648-54) and Brindley (2005, CJEM. 7(4): 227) and Jenkins (2006, J Hosp Med. 1(5): 285-295).

Typically, the therapeutic agents will be administered in pharmaceutical (or veterinary) compositions together with a pharmaceutically acceptable carrier and in an effective amount to achieve their intended purpose. The dose of active compounds administered to a subject should be sufficient to achieve a beneficial response in the subject over time such as a reduction in, or relief from, the symptoms of inSIRS, ipSIRS or particular stages of ipSIRS. The quantity of the pharmaceutically active compounds(s) to be administered may depend on the subject to be treated inclusive of the age, sex, weight and general health condition thereof. In this regard, precise amounts of the active compound(s) for administration will depend on the judgment of the practitioner. In determining the effective amount of the active compound(s) to be administered in the treatment or prevention of inSIRS, ipSIRS or particular stages of ipSIRS, the medical practitioner or veterinarian may evaluate severity of any symptom associated with the presence of inSIRS, ipSIRS or particular stages of ipSIRS including, inflammation, blood pressure anomaly, tachycardia, tachypnea fever, chills, vomiting, diarrhea, skin rash, headaches, confusion, muscle aches, seizures. In any event, those of skill in the art may readily determine suitable dosages of the therapeutic agents and suitable treatment regimens without undue experimentation.

The therapeutic agents may be administered in concert with adjunctive (palliative) therapies to increase oxygen supply to major organs, increase blood flow to major organs and/or to reduce the inflammatory response. Illustrative examples of such adjunctive therapies include non-steroidal-anti-inflammatory drugs (NSAIDs), intravenous saline and oxygen.

In specific embodiments of the present invention, the methods, apparatus and kits described above and elsewhere herein are contemplated for use in methods of treating, preventing or inhibiting the development of at least one condition selected from inSIRS, ipSIRS or a particular stage of ipSIRS (e.g., mild sepsis, severe sepsis or septic shock) in a subject. These methods (also referred to herein as "treatment methods") generally comprise: (a) determining a plurality of IRS biomarker values, each IRS biomarker value being indicative of a value measured or derived for at least one (e.g., 1, 2, 3, 4, 5, 6, 7, 8, 9, 10, or more) IRS biomarker of a biological subject; (b) determining an indicator using a combination of the plurality of IRS biomarker values, the indicator being at least partially indicative of the presence, absence or degree of the at least one condition, wherein: (i) at least two (e.g., 2, 3, 4, 5, 6, 7, 8, 9, 10, or more) IRS biomarkers have a mutual correlation in respect of the at least one condition that lies within a mutual correlation range, the mutual correlation range being between ±0.9; and (ii) the indicator has a performance value greater than or equal to a performance threshold representing the ability of the indicator to diagnose the presence, absence or degree of the at least one condition, the performance threshold being indicative of an explained variance of at least 0.3; and (c) administering to the subject, on the basis that the indicator indicates the presence of inSIRS, an effective amount of an agent that treats or ameliorates the symptoms or reverses or inhibits the development of inSIRS, or administering to the subject, on the basis that the indicator indicates the presence of ipSIRS or a particular stage of ipSIRS, an effective amount of an agent that treats or ameliorates the symptoms or reverses or inhibits the development of ipSIRS or the particular stage of ipSIRS.

In advantageous embodiments, the treatment methods comprise: (1) determining a plurality of measured IRS biomarker values, each measured IRS biomarker value being a measured value of an IRS biomarker of the biological subject; and (2) applying a function to at least one of the measured IRS biomarker values to determine at least one derived IRS biomarker value, the at least one derived IRS biomarker value being indicative of a value of a corresponding derived IRS biomarker. The function suitably includes at least one of: (a) multiplying two IRS biomarker values; (b) dividing two IRS biomarker values; (c) adding two IRS biomarker values; (d) subtracting two IRS biomarker values; (e) a weighted sum of at least two IRS biomarker values; (f) a log sum of at least two IRS biomarker values; and (g) a sigmoidal function of at least two IRS biomarker values.

In some embodiments the methods, apparatus and kits of the present invention are used for monitoring, treatment and management of conditions that can lead to inSIRS or ipSIRS, illustrative examples of which include retained placenta, meningitis, endometriosis, shock, toxic shock (i.e., sequelae to tampon use), gastroenteritis, appendicitis, ulcerative colitis, Crohn's disease, inflammatory bowel disease, acid gut syndrome, liver failure and cirrhosis, failure of colostrum transfer in neonates, ischemia (in any organ), bacteremia, infections within body cavities such as the peritoneal, pericardial, thecal, and pleural cavities, burns, severe wounds, excessive exercise or stress, hemodialysis, conditions involving intolerable pain (e.g., pancreatitis, kidney stones), surgical operations, and non-healing lesions. In these embodiments, the methods or kits of the present invention are typically used at a frequency that is effective to monitor the early development of inSIRS, ipSIRS or particular stages of ipSIRS, to thereby enable early therapeutic intervention and treatment of that condition. In illustrative examples, the diagnostic methods or kits are used at least at 1, 2, 3, 4, 5, 6, 7, 8, 9, 10, 11, 12, 13, 14, 15, 16, 17, 18, 19, 20, 21, 22, 23 or 24 hour intervals or at least 1, 2, 3, 4, 5 or 6 day intervals, or at least weekly, fortnightly or monthly.

The present invention can be practiced in the field of predictive medicine for the purpose of diagnosis or monitoring the presence or development of a condition selected from inSIRS, ipSIRS or a particular stage of ipSIRS in a subject, and/or monitoring response to therapy efficacy.

The biomarker signatures and corresponding indicators of the present invention further enable determination of endpoints in pharmacotranslational studies. For example, clinical trials can take many months or even years to establish the pharmacological parameters for a medicament to be used in treating or preventing inSIRS, ipSIRS or a particular stage of ipSIRS (e.g., mild sepsis, severe sepsis and septic shock). However, these parameters may be associated with a biomarker signature and corresponding indicator of a health state (e.g., a healthy condition). Hence, the clinical trial can be expedited by selecting a treatment regimen (e.g., medicament and pharmaceutical parameters), which results in a biomarker signature associated with a desired health state (e.g., healthy condition). This may be determined for example by: a) determining a plurality of IRS biomarker values, each IRS biomarker value being indicative of a value measured or derived for at least one (e.g., 1, 2, 3, 4, 5, 6, 7, 8, 9, 10, or more) IRS biomarker of a biological subject after treatment with a treatment regimen; (b) determining an indicator using a combination of the plurality of IRS biomarker values, the indicator being at least partially indicative of the presence, absence or degree of at least one condition selected from a healthy condition, inSIRS, ipSIRS or a particular stage of ipSIRS, wherein: (i) at least two (e.g., 2, 3, 4, 5, 6, 7, 8, 9, 10, or more) IRS biomarkers have a mutual correlation in respect of the at least one condition that lies within a mutual correlation range, the mutual correlation range being between ±0.9; and (ii) the indicator has a performance value greater than or equal to a performance threshold representing the ability of the indicator to diagnose the presence, absence or degree of the at least one condition, or to provide a prognosis for the at least one condition, the performance threshold being indicative of an explained variance of at least 0.3, and (c) determining that the treatment regimen is effective for changing the health status of the subject to the desired health state (e.g., healthy condition) on the basis that the indicator indicates the presence of a healthy condition or the presence of a condition of a lower degree relative to the degree of the condition in the subject before treatment with the treatment regimen. As used herein, the term "degree" refers to the extent or stage of a condition. Thus, for example, mild sepsis is a stage or degree of sepsis that is lower than severe sepsis. Similarly, severe sepsis is a stage or degree of sepsis that is lower than septic shock. Accordingly, this aspect of the present invention advantageously provides methods of monitoring the efficacy of a particular treatment regimen in a subject (for example, in the context of a clinical trial) already diagnosed with a condition selected from inSIRS, ipSIRS or a particular stage of ipSIRS. These methods take advantage of measured or derived IRS biomarker values that correlate with treatment efficacy to determine, for example, whether measured or derived IRS biomarker values of a subject undergoing treatment partially or completely normalize during the course of or following therapy or otherwise shows changes associated with responsiveness to the therapy.

As used herein, the term "treatment regimen" refers to prophylactic and/or therapeutic (i.e., after onset of a specified condition) treatments, unless the context specifically indicates otherwise. The term "treatment regimen" encompasses natural substances and pharmaceutical agents (i.e., "drugs") as well as any other treatment regimen including but not limited to dietary treatments, physical therapy or exercise regimens, surgical interventions, and combinations thereof.

Accordingly, the invention provides methods of correlating a biomarker signature with an effective treatment regimen for a condition selected from inSIRS, ipSIRS or a particular stage of ipSIRS (e.g., mild sepsis, severe sepsis and septic shock), wherein the methods generally comprise: (a) determining a biomarker signature defining a combination of at least two (e.g., 2, 3, 4, 5, 6, 7, 8, 9, 10, or more) IRS biomarker values corresponding to values of at least two IRS biomarkers that can be measured for or derived from a biological subject having the condition and for whom an effective treatment has been identified, wherein: (i) the at least two IRS biomarkers have a mutual correlation in respect of the condition that lies within a mutual correlation range, the mutual correlation range being between ±0.9; and (ii) the combination of at least two biomarker values has a performance value greater than or equal to a performance threshold representing the ability of the combination of at least two biomarker values to diagnose the presence, absence or degree of the condition, or to provide a prognosis for the condition, the performance threshold being indicative of an explained variance of at least 0.3; and (b) correlating the biomarker signature so determined with an effective treatment regimen for the condition. The term "correlating" generally refers to determining a relationship between one type of data with another or with a state. In specific embodiments, an indicator or biomarker signature is correlated to a global probability or a particular outcome, using receiver operating characteristic (ROC) curves.

The invention further provides methods of determining whether a treatment regimen is effective for treating a subject with a condition selected from inSIRS, ipSIRS or a particular stage of ipSIRS (e.g., mild sepsis, severe sepsis and septic shock). These methods generally comprise: (a) determining a plurality of post-treatment IRS biomarker values, each post-treatment IRS biomarker value being indicative of a value measured or derived for at least one (e.g., 1, 2, 3, 4, 5, 6, 7, 8, 9, 10, or more) IRS biomarker of a biological subject after treatment with the treatment regimen; (b) determining a post-treatment indicator using a combination of the plurality of post-treatment IRS biomarker values, the post-treatment indicator being at least partially indicative of the presence, absence or degree of at least one condition selected from a healthy condition, inSIRS, ipSIRS or a particular stage of ipSIRS, wherein: (i) at the least two (e.g., 2, 3, 4, 5, 6, 7, 8, 9, 10, or more) IRS biomarkers have a mutual correlation in respect of the at least one condition that lies within a mutual correlation range, the mutual correlation range being between ±0.9; and (ii) the post-treatment indicator has a performance value greater than or equal to a performance threshold representing the ability of the post-treatment indicator to diagnose the presence, absence or degree of the at least one condition, the performance threshold being indicative of an explained variance of at least 0.3, wherein the post-treatment indicator indicates whether the treatment regimen is effective for treating the condition in the subject on the basis that post-treatment indicator indicates the presence of a healthy condition or the presence of a condition of a lower degree relative to the degree of the condition in the subject before treatment with the treatment regimen.

The invention can also be practiced to evaluate whether a subject is responding (i.e., a positive response) or not responding (i.e., a negative response) to a treatment regimen or has a side effect to a treatment regimen. This aspect of the invention provides methods of correlating a biomarker signature with a positive or negative response or a side effect to a treatment regimen, which generally comprise: (a) determining a biomarker signature defining a combination of at least two (e.g., 2, 3, 4, 5, 6, 7, 8, 9, 10, or more) IRS biomarker values corresponding to values of at least two IRS biomarkers that can be measured for or derived from a biological subject following commencement of the treatment regimen, wherein: (i) the at least two IRS biomarkers have a mutual correlation in respect of at least one condition selected from a healthy condition, inSIRS, ipSIRS or a particular stage of ipSIRS, which lies within a mutual correlation range, the mutual correlation range being between ±0.9; and (ii) the combination of at least two biomarker values has a performance value greater than or equal to a performance threshold representing the ability of the combination of at least two biomarker values to diagnose the presence, absence or degree of the at least one condition, or to provide a prognosis for the at least one condition, the performance threshold being indicative of an explained variance of at least 0.3; and (b) correlating the biomarker signature so determined with a positive or negative response to the treatment regimen. As used herein, the term "positive response" means that the result of the treatment regimen includes some clinically significant benefit, such as the prevention, or reduction of severity, of symptoms, or a slowing of the progression of the condition. By contrast, the term "negative response" means that the treatment regimen provides no clinically significant benefit, such as the prevention, or reduction of severity, of symptoms, or increases the rate of progression of the condition.

The invention also encompasses methods of determining a positive or negative response to a treatment regimen and/or a side effect of a treatment regimen by a subject with a condition selected from inSIRS, ipSIRS or a particular stage of ipSIRS. These methods generally comprise: (a) correlating a reference biomarker signature with a positive or negative response or a side effect to the treatment regimen, wherein the biomarker signature defines a combination of at least two (e.g., 2, 3, 4, 5, 6, 7, 8, 9, 10, or more) IRS biomarker values corresponding to values of at least two IRS biomarkers that are measured for or derived from a control biological subject or control group, wherein: (i) the at least two IRS biomarkers have a mutual correlation in respect of at least one condition selected from a healthy condition, inSIRS, ipSIRS or a particular stage of ipSIRS, which lies within a mutual correlation range, the mutual correlation range being between ±0.9; and (ii) the combination of at least two biomarker values has a performance value greater than or equal to a performance threshold representing the ability of the combination of at least two biomarker values to diagnose the presence, absence or degree of the at least one condition, or to provide a prognosis for the at least one condition, the performance threshold being indicative of an explained variance of at least 0.3; (b) determining a sample biomarker signature defining a combination of at least two (e.g., 2, 3, 4, 5, 6, 7, 8, 9, 10, or more) IRS biomarker values corresponding to values of at least two IRS biomarkers that are measured for or derived from a biological subject following commencement of the treatment regimen, wherein: (i) the at least two IRS biomarkers have a mutual correlation in respect of at least one condition selected from a healthy condition, inSIRS, ipSIRS or a particular stage of ipSIRS, which lies within a mutual correlation range, the mutual correlation range being between ±0.9; and (ii) the combination of at least two biomarker values has a performance value greater than or equal to a performance threshold representing the ability of the combination of at least two biomarker values to diagnose the presence, absence or degree of the at least one condition, or to provide a prognosis for the at least one condition, the performance threshold being indicative of an explained variance of at least 0.3; wherein the sample biomarker signature indicates whether the subject is responding positively or negatively to the treatment regimen and/or is developing a side effect from the treatment regimen, based on the correlation of the reference biomarker signature with the positive or negative response or side effect to the treatment regimen.

In related embodiments, the present invention further contemplates methods of determining a positive or negative response to a treatment regimen and/or a side effect to a treatment regimen by a biological subject. These methods generally comprise: (a) determining a sample biomarker signature defining a combination of at least two (e.g., 2, 3, 4, 5, 6, 7, 8, 9, 10, or more) IRS biomarker values corresponding to values of at least two IRS biomarkers that are measured for or derived from a biological subject following commencement of the treatment regimen, wherein: (i) the at least two IRS biomarkers have a mutual correlation in respect of at least one condition selected from a healthy condition, inSIRS, ipSIRS or a particular stage of ipSIRS, which lies within a mutual correlation range, the mutual correlation range being between ±0.9; and (ii) the combination of at least two biomarker values has a performance value greater than or equal to a performance threshold representing the ability of the combination of at least two biomarker values to diagnose the presence, absence or degree of the at least one condition, or to provide a prognosis for the at least one condition, the performance threshold being indicative of an explained variance of at least 0.3, wherein the sample biomarker signature is correlated with a positive or negative response to the treatment regimen and/or to a side effect from the treatment regimen; and (b) determining whether the subject is responding positively or negatively to the treatment regimen and/or is developing a side effect from the treatment regimen based on the sample biomarker signature.

This above methods can be practiced to identify responders or non-responders relatively early in the treatment process, i.e., before clinical manifestations of efficacy. In this way, the treatment regimen can optionally be discontinued, a different treatment protocol can be implemented and/or supplemental therapy can be administered. Thus, in some embodiments, a sample IRS biomarker signature is obtained within about 2 hours, 4 hours, 6 hours, 12 hours, 1 day, 2 days, 3 days, 4 days, 5 days, 1 week, 2 weeks, 3 weeks, 4 weeks, 6 weeks, 8 weeks, 10 weeks, 12 weeks, 4 months, six months or longer of commencing therapy.

A number of non-limiting example signatures for use in diagnosing respective conditions will now be described. For the purpose of illustration, the above-described process was used to select biomarkers that provided the theoretical best diagnostic biomarkers, selected from combinations including measured and/or derived biomarkers. Following this, other measured and/or derived biomarkers were grouped based on their correlation to the best diagnostic biomarkers, with the ability of biomarkers within these groups to act as a diagnostic signature then being assessed.

The results set out in detail below highlight that as long as the above-described criteria are met, the resulting signatures provide the required discriminatory ability for use in diagnosing the presence, absence, degree or prognosis of at least one condition in a biological subject.

Signature Derivation

An illustrative process for the identification of mRNA biomarkers for use in diagnostic algorithms will now be described.

Summary

Peripheral blood samples were obtained from healthy controls and patients retrospectively diagnosed by a panel of physicians with either inSIRS or ipSIRS (blood culture positive). ipSIRS patients were further classified retrospectively into "mild", "severe" or "shock" based on clinical parameters. Total RNA from patient samples was then used in gene expression analysis (GeneChip® and/or quantitative PCR (qPCR)). Gene expression data were analyzed using a variety of statistical approaches to identify individual and derived markers. Derived markers were divided into groups based on how they correlated to each of the markers in the top-performing (based on AUC) ratio. This ratio approach provides the best diagnostic power with respect to AUC for separating: healthy and post-surgical (PS) (also referred to herein as "inSIRS") conditions; healthy and sepsis (also referred to herein as "ipSIRS"); inSIRS and ipSIRS; mild ipSIRS and severe ipSIRS; mild ipSIRS and septic shock; and severe ipSIRS and septic shock.

Clinical Trials

Clinical trials were performed to determine whether certain mRNA transcripts could distinguish between healthy controls and various patient groups and within patient groups. Intensive care sepsis, post-surgical and inSIRS patients, as well as healthy controls were prospectively enrolled and attended a single visit where blood was collected for gene expression and mRNA analyses using Affymetrix exon arrays and/or quantitative real-time PCR (qRT-PCR). A definitive diagnosis of infection-positive SIRS (mild, severe or shock) or inSIRS was unlikely to be known at the time patients were enrolled, and thus confirmation of a diagnosis and the assignment of patients to the cohorts were made retrospectively.

Patients who had clinical signs and/or symptoms of ipSIRS or inSIRS were consented and enrolled into the study as soon as possible after they had been identified, in most cases within 24 hours of admission. Final assessment of whether the participant had inSIRS, ipSIRS (mild, severe, or shock) was made retrospectively as clinical information and blood culture results became available.

Study participants were all over 18 years and either they or their surrogate decision maker signed and dated the clinical trial information sheet and consent form. All of the control participants were considered to be in good health based on a brief physical examination and their medical history at the time of enrolment.

Patients or their surrogate decision maker were offered the opportunity to participate in this study if the patient presented with signs and symptoms of either inSIRS or ipSIRS at the time of admission to ICU (using criteria based on the American College of Physicians and the Society of Critical Care Medicine standard definitions). That is, inSIRS and ipSIRS participants needed a variable combination of clinical conditions including two or more of the following within the last 24 hours: temperature >38° C. or <36° C.; heart rate >90 beats/min; respiratory rate >20 breathes/min or a $PaCO_2$ of <4.3 kPa (<32 mm Hg); and evidence of a white blood cell count <4,000 cells/mm$^3$ (<4×10$^9$ cells/L) or >12,000 cells/mm$^3$ (>12×10$^9$ cells/L) or >10% immature neutrophils (band forms). Participants were excluded if they had any chronic systemic immune-inflammatory disorders including SLE, Crohn's disease, insulin-dependent diabetes mellitus (IDDM); were transplant recipients or were currently receiving chemotherapy treatment for cancer. Most patients had other underlying co-morbidities. All study participants were 18 years of age or older and had a body mass index of less than 40.

Demography, vital signs measurements (blood pressure, heart rate, respiratory rate, oxygen saturation, temperature), hematology (full blood count), clinical chemistry (urea, electrolytes, liver function enzymes, blood glucose) as well as microbial status was recorded.

Blood was collected for the purpose of extraction of high quality RNA into PAXgene™ tubes (PreAnalytix Inc., Valencia, Calif., USA). Blood for bacterial culture was collected into BacTec Plus Aerobic (10 ml) and BacTec Plus Anaerobic (10 mL) tubes (Becton Dickinson) tubes for the detection of aerobic and anaerobic bacterial growth respectively.

A PAXgene blood RNA kit available from Qiagen Inc. (Valencia, Calif., USA) was used to isolate total RNA from PAXgene tubes. Isolation begins with a centrifugation step to pellet nucleic acids in the PAXgene blood RNA tube. The pellet is washed and re-suspended and incubated in optimized buffers together with Proteinase K to bring about protein digestion. An additional centrifugation is carried out to remove residual cell debris and the supernatant is transferred to a fresh microcentrifuge tube. Ethanol is added to adjust binding conditions, and the lysate is applied to the PAXgene RNA spin column. During brief centrifugation, RNA is selectively bound to the silica-gel membrane as contaminants pass through. Remaining contaminants are removed in three efficient wash steps and RNA is then eluted in Buffer BR5. Determination of RNA quantity and quality was performed using an Agilent Bioanalyzer and Absorbance 260/280 ratio using a spectrophotometer.

Processing of Samples

Measurement of specific mRNA levels in a tissue sample can be achieved using a variety of technologies. A common and readily available technology that covers most of the known human mRNAs is GeneChip® analysis using Affymetrix technology. Details on the technology and methodology can be found at www.affymetrix.com. GeneChip® analysis has the advantage of being able to analyze thousands of RNA transcripts at a time. Another common and readily available technology is qPCR (quantitative polymerase chain reaction), which has the advantage of being able to analyze, in real-time and quantitatively, hundreds of RNA transcripts at a time. Details on one of these technologies (TaqMan®), chemistries and methodologies can be found on the Life Technologies website including published protocols entitled; "Protocol: Introduction to TaqMan SYBR Green Chemistries for Real-Time PCR" and "TaqMan Gene Expression Assays Protocol." Both GeneChip® and qPCR were used in the discovery and proof-of-concept stages for biomarker identification. qPCR was used exclusively for biomarker feasibility testing.

Analysis, Interpretation of Data and Selection of Biomarkers and Derived Biomarkers Healthy Control Versus inSIRS A list of 941 mRNA individual markers with an AUC of at least 0.7 for separating the two conditions of Healthy and inSIRS was generated. FIG. 8A plots these markers against the AUC and FIG. 8B is a box and whisker plot of the best mRNA biomarker for separating the two conditions (AGFG1—ArfGAP with FG repeats 1). The conditions of Healthy and inSIRS are perfectly separated when using this mRNA biomarker alone.

From the 941 individual markers at least 1000 derived markers (ratios) were generated that had an AUC of 1.0. A plot of the AUC of these derived markers for separating the conditions of Healthy and inSIRS is shown in FIG. 8C with the top performing ratio shown as a box and whisker plot in FIG. 8D. The AUC for AGFG1 and PVRIG (poliovirus receptor related immunoglobulin domain containing) has a ratio is 1.0.

All 941 individual markers were then broken into two groups—those that correlate to AGFG1 and those that correlate to PVRIG. FIGS. 8E and 8F demonstrate the correlation between the two groups based on their similarity to either AGFG1 or PVRIG. In these plots the groups are referred to as either group 1 (AGFG1) or group 2 (PVRIG). It can be seen that each "group" contains those markers that are most highly correlated to each other.

The markers in each "group" also correlate strongly (as demonstrated by AUC greater than 0.7 for all markers) to the condition being studied (in this instance Healthy versus inSIRS (PS)) as shown in FIGS. 8G and 8H.

By choosing mRNAs from these two groups to create derived markers a better AUC for separating Healthy and inSIRS is obtained than when markers are chosen from within groups (p<2.558e-13) as demonstrated in FIG. 8I, which shows a greater overall AUC is obtained compared to when using markers from either group 1 or group 2 alone. The mean AUC for markers derived from groups 1 and 2 is over 0.97, whereas the mean AUC for markers derived from either group 1 or 2 alone is less than 0.9.

Healthy Control Versus ipSIRS

Figure 9A:
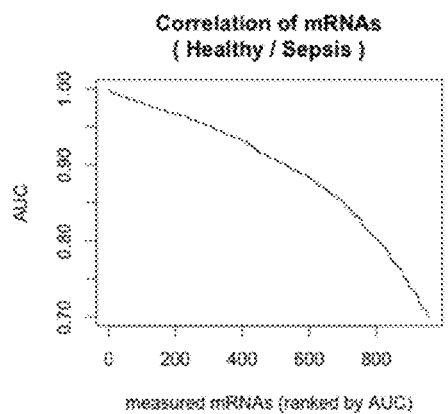
FIG. 9A is a plot of the 941 mRNA biomarkers against the AUC for differentiating between healthy condition and sepsis (also referred to herein as "infection-positive SIRS" (ipSIRS)) with all individual biomarkers having an AUC greater than 0.7.
Figure 9B:
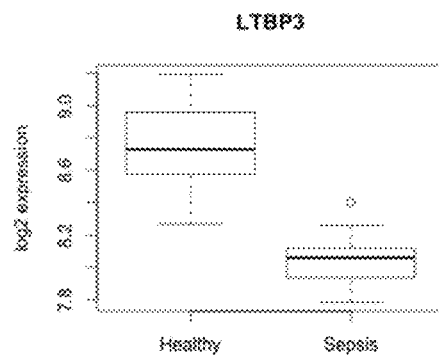
FIG. 9B is a box and whisker plot showing the best mRNA biomarker for separating healthy condition and sepsis.

A list of 941 mRNA individual markers with an AUC of at least 0.7 for separating the two conditions of Healthy and ipSIRS was generated. FIG. 9A plots these markers against the AUC and FIG. 9B is a box and whisker plot of the best mRNA biomarker for separating the two conditions (LTBP3—latent transforming growth factor beta binding protein 3). The conditions of Healthy and ipSIRS are perfectly separated when using this mRNA biomarker alone.

Figure 9C:
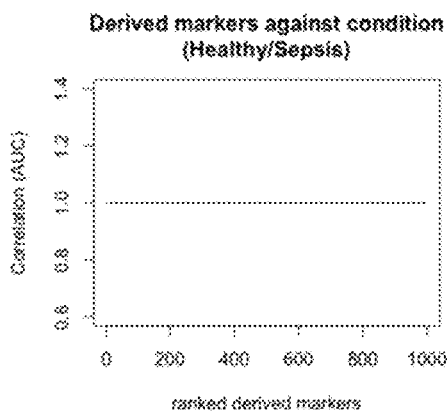
FIG. 9C is a plot of the AUC for the diagnostic ability of 1000 derived biomarkers in separating healthy condition and sepsis with all derived biomarkers having an AUC of 1.0.
Figure 9D:
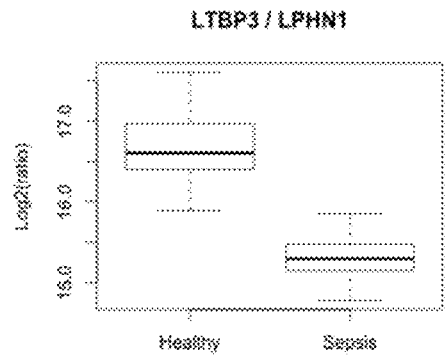
FIG. 9D is a box and whisker plot of the best performing derived biomarker, based on AUC, for separating healthy condition and sepsis.

From the 941 individual markers at least 1000 derived markers (ratios) were generated that had an AUC of 1.0. A plot of the AUC of these derived markers for separating the conditions of Healthy and inSIRS is shown in FIG. 9C with the top performing ratio shown as a box and whisker plot in FIG. 9D. The AUC for LTBP3 and LPHN1 (latrophilin 1) as a ratio is 1.0.

Figure 9E:
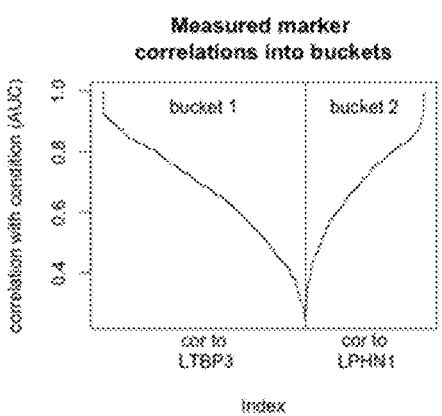
FIGS. 9E and 9F show the correlation to each other of the biomarkers groups correlated to each group.
Figure 9F:
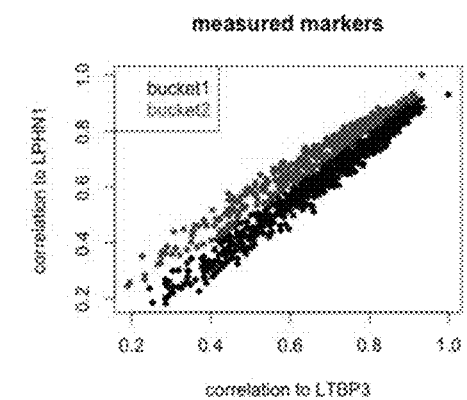

All 941 individual markers were then broken into two groups—those that correlate to LTBP3 and those that correlate to LPHN1. Both plots in FIGS. 9E and 9F demonstrate the correlation between the two groups based on their similarity to either LTBP3 or LPHN1. It can be seen that each "group" contains those markers that are most highly correlated to each other.

Figure 9G:
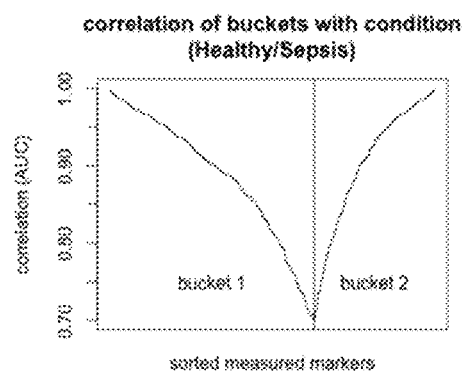
FIGS. 9G and 9H are two plots demonstrating the AUC of the biomarkers in each group (bucketgroups 1 and 2)
Figure 9H:
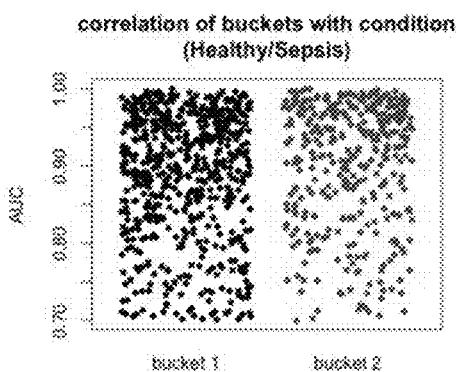

The markers in each "group" also correlate strongly (as demonstrated by AUC greater than 0.7 for all markers) to the condition being studied (in this instance Healthy versus ipSIRS (sepsis)), as shown in FIGS. 9G and 9H.

Figure 9I:
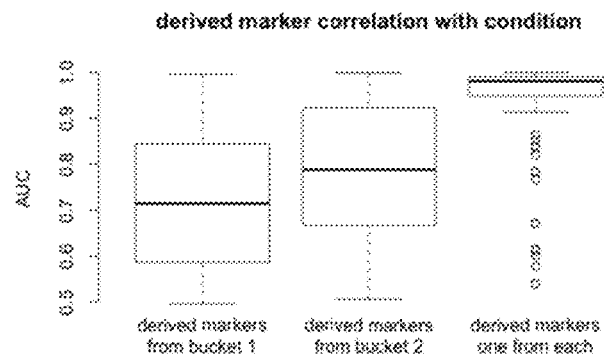
FIG. 9I is a box and whisker plot showing that when biomarkers are derived from bucketgroup 1 and bucketgroup 2 that a greater overall AUC is obtained.

By choosing mRNAs from these two groups to create derived markers a better AUC for separating Healthy and ipSIRS is obtained than when markers are chosen from within groups (p<2.2e-16) as demonstrated in FIG. 9I, which shows an improved AUC compared to using markers from either group 1 or group 2 alone. The mean AUC for markers derived from groups 1 and 2 is over 0.97, whereas the mean AUC for markers derived from either group 1 or 2 alone is less than 0.8.

inSIRS Versus ipSIRS

A list of 359 mRNA individual markers with an AUC of at least 0.7 for separating the two conditions of inSIRS and ipSIRS was generated. FIG. 10A plots these markers against the AUC and FIG. 10B is a box and whisker plot of the best mRNA biomarker for separating the two conditions (PI-WIL4—piwi-like RNA mediated gene silencing 4). The conditions of inSIRS (PS) and ipSIRS (sepsis) are well separated when using this mRNA biomarker alone.

From the 359 individual markers 1000 derived markers (ratios) were generated that had an AUC greater than 0.9. A plot of the AUC of these derived markers for separating the conditions of inSIRS and ipSIRS is shown in FIG. 10C with the top performing ratio of PLA2G7 (phospholipase A2, Group VII, (platelet activating factor acetyl hydrolase, plasma)) and PLAC8 (placenta-specific 8) shown as a box and whisker plot in FIG. 10D.

All 359 individual markers were then broken into two groups—those that correlate to PLA2G7 and those that correlate to PLAC8. The plot in FIG. 10E demonstrates that the markers in each "group" correlate strongly (as demonstrated by AUC greater than 0.7 for all markers) to the condition being studied (in this instance inSIRS (PS) versus ipSIRS (sepsis)).

Figure 10F:
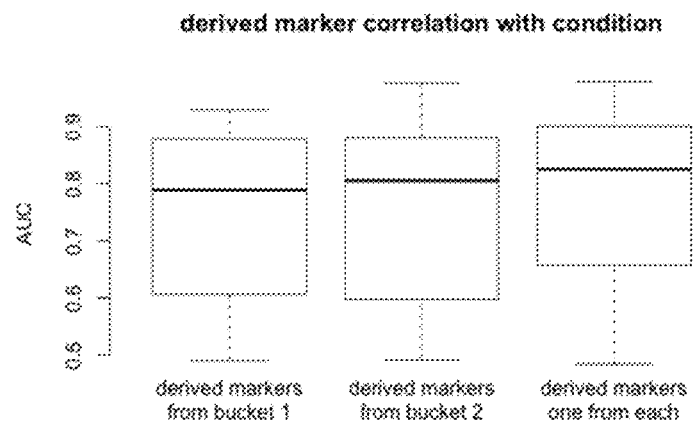
FIG. 10F is a box and whisker plot showing that when biomarkers are derived from bucketgroup 1 and bucketgroup 2 that a greater overall AUC is obtained.

By choosing mRNAs from these two groups to create derived markers a better AUC for separating inSIRS (PS) and ipSIRS (sepsis) is obtained than when markers are chosen from within groups (p<5.78e-5) as demonstrated in FIG. 10F compared to when using markers from either group 1 or group 2 alone. The mean AUC for markers derived from groups 1 and 2 is over 0.80, whereas the mean AUC for markers derived from either group 1 or 2 alone is less than 0.8.

Figure 10G:
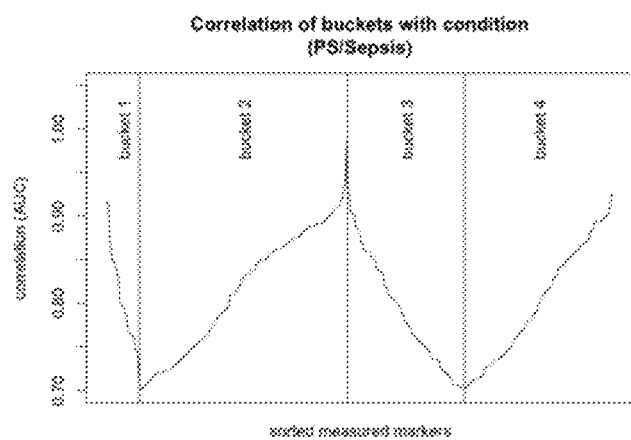
FIG. 10G is a plot demonstrating the AUC of the biomarkers in each of four bucketgroups.
Figure 10H:
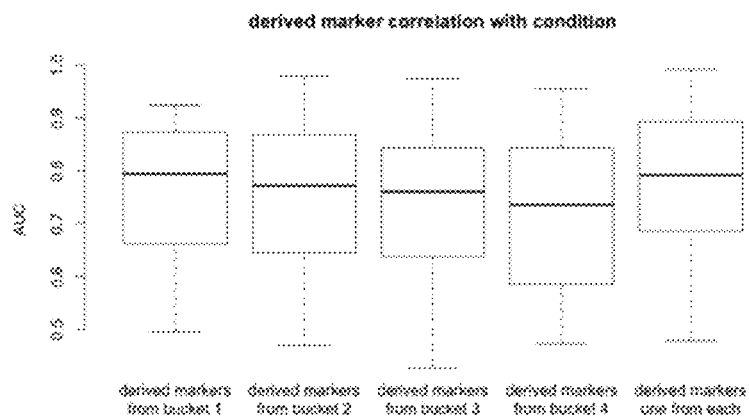
FIG. 10H is a box and whisker plot showing that when biomarkers are derived from each of the four bucketgroups a greater overall AUC is obtained.

In an alternative embodiment, the markers were broken into four groups—those that correlate to CEACAM4 (bucket 3), those that correlate to LAMP1 (bucket 4), those that correlate to PLA2G7 (bucket 1) and those that correlate to PLAC8 (bucket 2). The plots in FIG. 10G demonstrate the markers in each group correlate strongly (as demonstrated by AUC greater than 0.7 for all markers) to the condition being studied (i.e., inSIRS (PS) versus ipSIRS (sepsis)). Like the two-bucket embodiment discussed above, choosing mRNAs from four groups to create derived markers results in an overall better AUC for separating inSIRS (PS) and ipSIRS (sepsis), as compared to when markers are chosen from within groups (p<0.2564, as demonstrated in FIG. 10H compared to when using markers from any one of groups 1 to 4. The mean AUC for markers derived from groups 1 to 4 is over 0.8 whereas the mean AUC for markers derived from any one of groups 1 to 4 is less than 0.8

Mild ipSIRS Versus Severe ipSIRS

A list of 66 mRNA individual markers with an AUC of at least 0.7 for separating the two conditions of mild ipSIRS and severe ipSIRS was generated. FIG. 11A plots these markers against the AUC and FIG. 11B is a box and whisker plot of the best mRNA biomarker for separating the two conditions (N4BP2L2—NEDD4 binding protein 2-like 2). The conditions of mild ipSIRS and severe ipSIRS are well separated when using this mRNA biomarker alone.

From the 66 individual markers at least 1000 derived markers (ratios) were generated that had an AUC of 0.87. A plot of the AUC of these derived markers for separating the conditions of mild ipSIRS and severe ipSIRS is shown in FIG. 11C with the top performing ratio shown as a box and whisker plot in FIG. 11D. The AUC for N4BP2L2 and ZC3H11A (zinc finger CCCH-type containing 11A) as a ratio is 0.983.

All 66 individual markers were then broken into two groups—those that correlate to N4BP2L2 and those that correlate to ZC3H11A. Both plots in FIGS. 11E and 11F demonstrate the correlation between the two groups based on their similarity to either N4BP2L2 or ZC3H11A. In these plots the groups are referred to as either group 1 (N4BP2L2) or group 2 (ZC3H11A). It can be seen that each "group" contains those markers that are most highly correlated to each other. The markers in each "group" also correlate strongly (as demonstrated by AUC greater than 0.7 for all markers) to the condition being studied (in this instance mild ipSIRS versus severe ipSIRS).

Figure 11I:
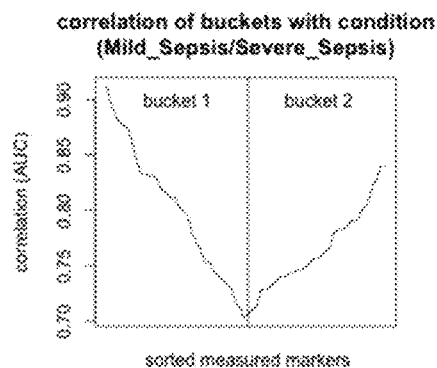
FIG. 11I is a box and whisker plot showing that when biomarkers are derived from group 1 and group 2 that a greater overall AUC is obtained.
Figure 11I:
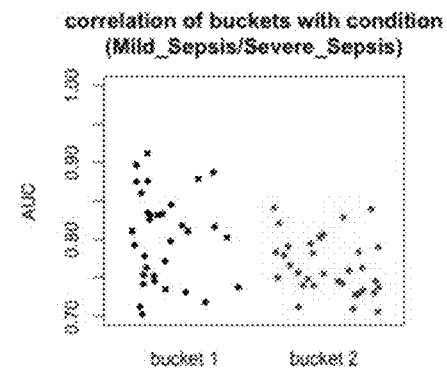
Figure 11I:
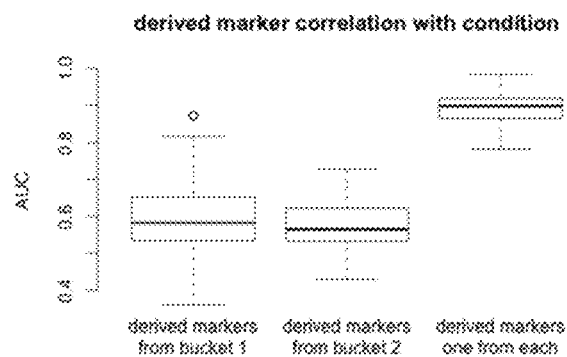

By choosing mRNAs from these two groups to create derived markers a better AUC for separating mild ipSIRS and severe ipSIRS is obtained than when markers are chosen from within groups ($p<2.2e-16$) as demonstrated in FIG. 11I, compared to when using markers from either group 1 or group 2 alone. The mean AUC for markers derived from groups 1 and 2 is over 0.89, whereas the mean AUC for markers derived from either group 1 or 2 alone is less than 0.6.

Mild ipSIRS Versus ipSIRS—Shock

Figure 12A:
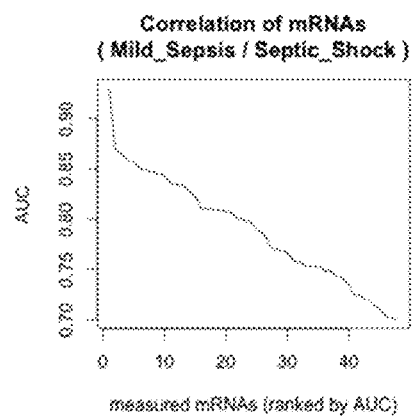
FIG. 12A is a plot of the 48 mRNA biomarkers against the AUC for differentiating between mild sepsis and septic shock (also referred to herein as "infection-positive SIRS-shock" (ipSIRS-shock)) with all individual biomarkers having an AUC greater than 0.7.
Figure 12B:
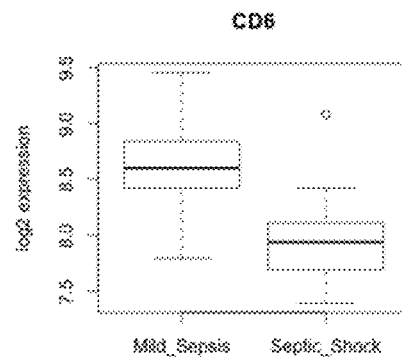
FIG. 12B is a box and whisker plot showing the best mRNA biomarker for separating mild sepsis and septic shock.

A list of 48 mRNA individual markers with an AUC of at least 0.7 for separating the two conditions of mild ipSIRS and ipSIRS—shock was generated. FIG. 12A plots these markers against the AUC and FIG. 12B is a box and whisker plot of the best mRNA biomarker for separating the two conditions (CD6-CD6 molecule). The conditions of mild ipSIRS and ipSIRS shock are well separated when using this mRNA biomarker alone.

Figure 12C:
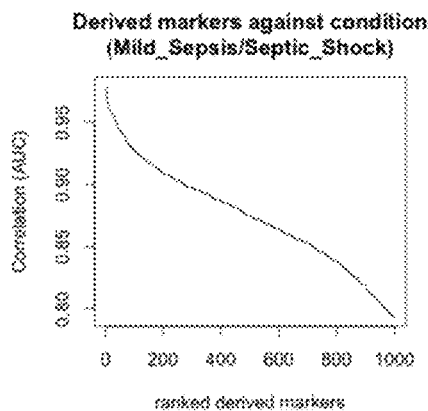
FIG. 12C is a plot of the AUC for the diagnostic ability of 1000 derived biomarkers in separating mild sepsis and septic shock with all derived biomarkers having an AUC of at least 0.793.
Figure 12D:
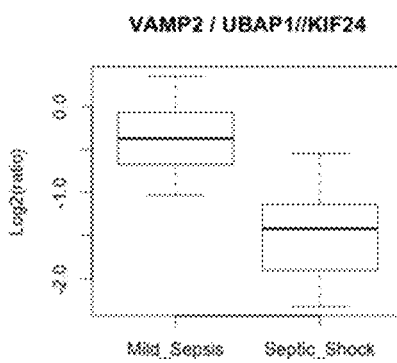
FIG. 12D is a box and whisker plot of the best performing derived biomarker, based on AUC, for separating mild sepsis and septic shock.

From the 48 individual markers at least 1000 derived markers (ratios) were generated that had an AUC of at least 0.793. A plot of the AUC of these derived markers for separating the conditions of mild ipSIRS and ipSIRS shock is shown in FIG. 12C with the top performing ratio shown as a box and whisker plot in FIG. 12D. The AUC for VAMP2 and UBAP1 (ubiquitin associated protein 1) as a ratio is 0.978.

Figure 12E:
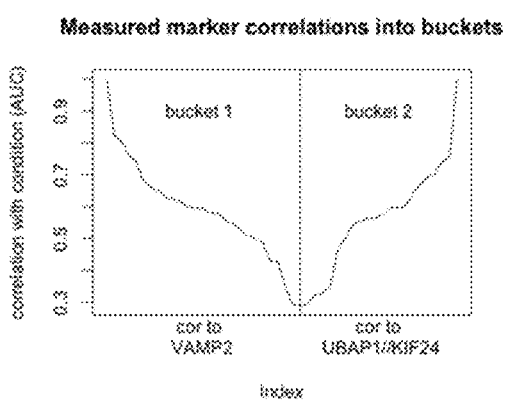
FIGS. 12E and 12F are plots showing the correlation to each other of the biomarkers in each group.
Figure 12F:
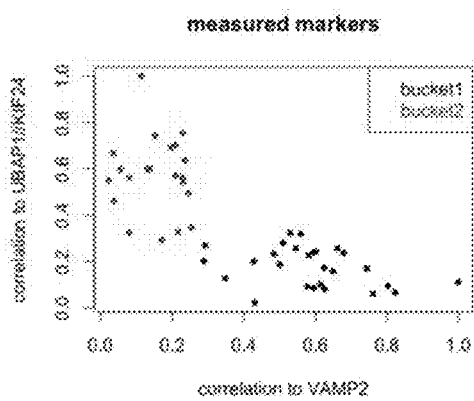
Figure 12G:
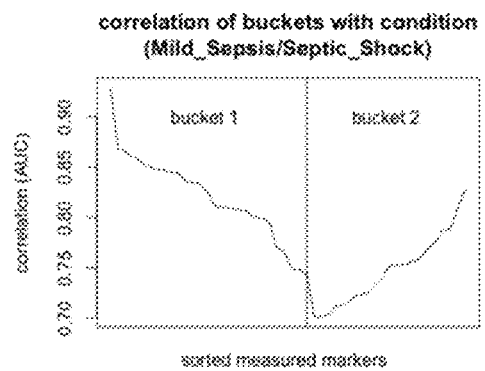
FIGS. 12G and 12H are plots demonstrating the AUC of the biomarkers in each group.
Figure 12H:
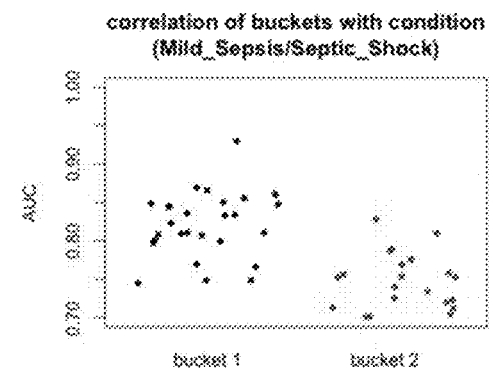

All 48 individual markers were then broken into two groups—those that correlate to VAMP2 and those that correlate to UBAP1. Both plots in FIGS. 12E and 12F demonstrate the correlation between the two groups based on their similarity to either VAMP2 or UBAP1. In these plots the groups are referred to as either group 1 (VAMP2) or group 2 (UBAP1). It can be seen that each "group" contains those markers that are most highly correlated to each other. The markers in each "group" also correlate strongly (as demonstrated by AUC greater than 0.7 for all markers) to the condition being studied (in this instance mild ipSIRS versus ipSIRS—shock).

Figure 12I:
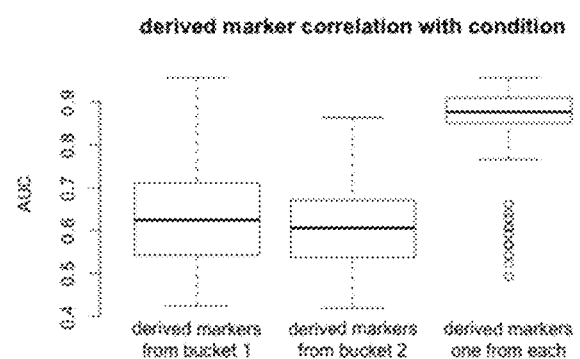
FIG. 12I is a box and whisker plot showing that when biomarkers are derived from group 1 and group 2 that a greater overall AUC is obtained.

By choosing mRNAs from these two groups to create derived markers a better AUC for separating mild ipSIRS and ipSIRS—shock is obtained than when markers are chosen from within groups ($p<2.2e-16$) as demonstrated in FIG. 12I, compared to when using markers from either group 1 or group 2 alone. The mean AUC for markers derived from groups 1 and 2 is over 0.87, whereas the mean AUC for markers derived from either group 1 or 2 alone is less than 0.65.

Severe ipSIRS Versus ipSIRS—Shock

Figure 13A:
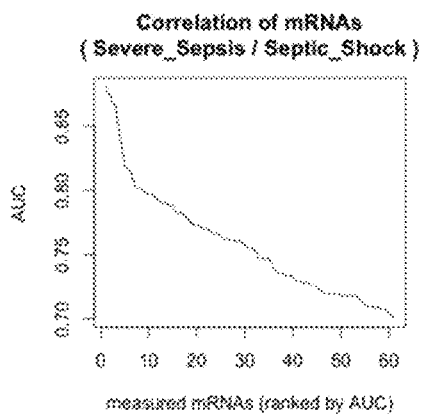
FIG. 13A is a plot of the 61 mRNA biomarkers against the AUC for differentiating between severe sepsis and septic shock with all individual biomarkers selected having an AUC greater than 0.7.
Figure 13B:
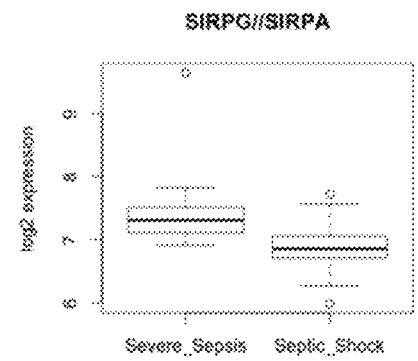
FIG. 13B is a box and whisker plot showing the best mRNA biomarker for separating severe sepsis and septic shock.

A list of 61 mRNA individual markers with an AUC of at least 0.7 for separating the two conditions of severe ipSIRS and ipSIRS—shock was generated. FIG. 13A plots these markers against the AUC and FIG. 13B is a box and whisker plot of the best mRNA biomarker for separating the two conditions (SIRPG—signal regulatory protein gamma) The conditions of severe ipSIRS and ipSIRS—shock are well separated when using this mRNA biomarker alone.

Figure 13C:
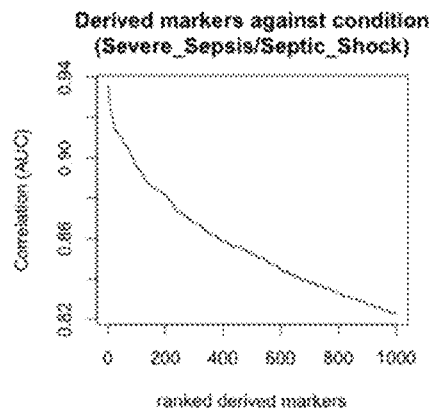
FIG. 13C is a plot of the AUC for the diagnostic ability of 1000 derived biomarkers in separating severe sepsis and septic shock with all derived biomarkers have an AUC of at least 0.821.
Figure 13D:
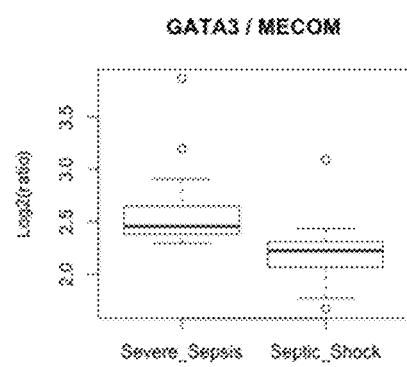
FIG. 13D is a box and whisker plot of the best performing derived biomarker, based on AUC, for separating severe sepsis and septic shock.

From the 61 individual markers at least 1000 derived markers (ratios) were generated that had an AUC of at least 0.821. A plot of the AUC of these derived markers for separating the conditions of severe ipSIRS and ipSIRS—shock is shown in FIG. 13C with the top performing ratio shown as a box and whisker plot in FIG. 13D. The AUC for GATA3 (GATA binding protein 3) and MECOM (MDS1 and EVI1 complex locus) as a ratio is 0.936.

Figure 13E:
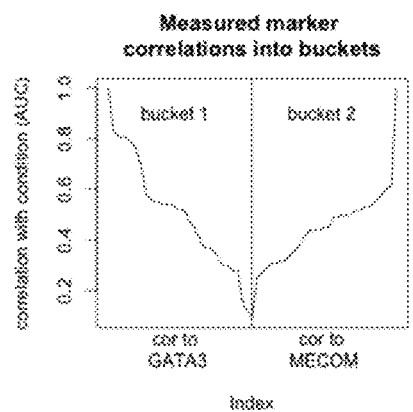
FIGS. 13E and 13F are plots showing the correlation to each other of the biomarkers in each group.
Figure 13F:
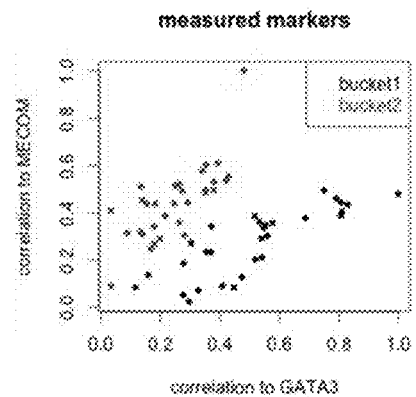

All 61 individual markers were then broken into two groups—those that correlate to GATA3 and those that correlate to MECOM. Both plots in FIGS. 13E and 13F demonstrate the correlation between the two groups based on their similarity to either GATA3 or MECOM. In these plots the groups are referred to as either group 1 (GATA3) or group 2 (MECOM). It can be seen that each "group" contains those markers that are most highly correlated to each other. The markers in each "group" also correlate strongly (as demonstrated by AUC greater than 0.7 for all markers) to the condition being studied (in this instance severe ipSIRS versus ipSIRS—shock).

By choosing mRNAs from these two groups to create derived markers a better AUC for separating severe ipSIRS and ipSIRS—shock is obtained than when markers are chosen from within groups ($p<2.2e-16$) as demonstrated in FIG. 13I compared to when using markers from either group 1 or group 2 alone. The mean AUC for markers derived from groups 1 and 2 is over 0.82, whereas the mean AUC for markers derived from either group 1 or 2 alone is less than 0.7.

Signature Usage

Use of the above described markers and resulting signatures in patient populations and benefits in respect of differentiating inSIRS and ipSIRS, will now be described.

An assay capable of differentiating patients with inSIRS and ipSIRS can be used in multiple patient populations including:

1) Intensive Care Unit (medical and surgical ICU)
2) Post-surgical and medical wards
3) Emergency Department
4) Medical clinics.

Patients admitted to intensive care (ICU) often have ipSIRS, or develop ipSIRS during their ICU stay. The ultimate aim of intensive care is to ensure the patient survives and is discharged to a general ward in the minimum time. Patients in intensive care with diagnosed ipSIRS are usually administered a number of therapeutic compounds—many of which have opposing actions on the immune system and many of which could be counterproductive depending on the severity of ipSIRS (mild sepsis, severe sepsis, septic shock). Monitoring intensive care patients on a regular basis with biomarkers of the present invention will allow medical practitioners to differentiate inSIRS from ipSIRS and determine the stage of ipSIRS and hence choice of therapies, when to start and stop therapies, and patient management procedures, and ultimately response to therapy. Information provided by these biomarkers will therefore allow medical intensivists to tailor and modify therapies to ensure patients survive and spend less time in intensive care. Less time in intensive care leads to considerable savings in medical expenses including through less occupancy time and appropriate use and timing of medications.

Surgical and general medical patients often develop inSIRS post-surgery or as a consequence of their condition or procedures and have a higher risk of developing ipSIRS. Post-operative and medical care in such patients therefore involves monitoring for signs of inSIRS and ipSIRS and differentiating between these two conditions. The treatment and management of inSIRS and ipSIRS patients post-surgically and in general wards is different, since inSIRS patients can be put on mild anti-inflammatory drugs or anti-pyretics and ipSIRS patients must be started on antibiotics as soon as possible for best outcomes. Monitoring post-surgical and medical patients on a regular basis with biomarkers of the present invention will allow nursing and medical practitioners to differentiate inSIRS and ipSIRS at an early stage and hence make informed decisions on choice of therapies and patient management procedures, and ultimately response to therapy. Information provided by these biomarkers will therefore allow medical practitioners to tailor and modify therapies to ensure patients recover quickly from surgery or other condition and do not develop ipSIRS. Less time in hospital and less complications leads to considerable savings in medical expenses including through less occupancy time and appropriate use and timing of medications.

Further, patients presenting to emergency departments often have a fever, which is one (of four) of the clinical signs of inSIRS. Such patients need to be assessed to determine if they have either inSIRS or ipSIRS. As mentioned above, the treatment and management of pyretic, inSIRS and septic patients are different. By way of example, a patient with a fever without other inSIRS clinical signs and no obvious source of infection may be sent home, or provided with other non-hospital services, without further hospital treatment. However, a patient with a fever may have early ipSIRS and not admitting such a patient may put their life at risk. Because these biomarkers can differentiate inSIRS and ipSIRS they will allow medical practitioners to triage emergency department patients quickly and effectively. Accurate triage decision-making insures that patients requiring hospital treatment are given it, and those that don't are provided with other appropriate services.

Further still, patients presenting to medical clinics often have any one of the four clinical signs of inSIRS (increased heart rate, increased respiratory rate, abnormal white blood cell count, fever or hypothermia). Many different clinical conditions can present with one of the four clinical signs of inSIRS and such patients need to be assessed to determine if they have either inSIRS or ipSIRS and to exclude other differential diagnoses. By way of example, a patient with colic might also present with clinical signs of increased heart rate. Differential diagnoses could be (but not limited to) appendicitis, urolithiasis, cholecystitis, pancreatitis, enterocolitis. In each of these conditions it would be important to determine if there was a systemic inflammatory response (inSIRS) or whether an infection was contributing to the systemic response to the condition (ipSIRS). The treatment and management of patients with and without systemic inflammation and/or infection are different. Because these biomarkers can differentiate patients with a systemic inflammatory response to infection from those with a systemic inflammatory response without infection (inSIRS and ipSIRS), and determine the degree of systemic involvement, the use of them will allow medical practitioners to determine the next medical procedure(s) to perform to satisfactorily resolve the patient issue.

Determining the Extent of Systemic Inflammation in Sick Patients and Those with inSIRS and ipSIRS As mentioned above, patients presenting to medical clinics often have any one of the four clinical signs of inSIRS. However, many different clinical conditions can present with one of the four clinical signs of inSIRS and such patients need to be assessed to determine if they have inSIRS, and if so the extent of inSIRS, or ipSIRS, and if so the extent of ipSIRS, and to exclude other differential diagnoses.

By way of example, a patient with respiratory distress is likely to present with clinical signs of increased respiratory rate. Differential diagnoses could be (but not limited to) asthma, pneumonia, congestive heart failure, physical blockage of airways, allergic reaction, collapsed lung, pneumothorax. In each of these conditions it would be important to determine if there was a systemic inflammatory response (inSIRS) or whether an infection was contributing to the condition. The treatment and management of patients with and without systemic inflammation and/or infection are different. Because these biomarkers can differentiate patients with a systemic inflammatory response to infection from those with a systemic inflammatory response without infection (inSIRS and ipSIRS), and determine the degree of systemic involvement, the use of them will allow medical practitioners to determine the next medical procedure(s) to perform to satisfactorily resolve the patient issue. Patients with a collapsed lung, pneumothorax or a physical blockage are unlikely to have a large systemic inflammatory response and patients with congestive heart failure, allergic reaction or asthma are unlikely to have a large systemic inflammatory response due to infection. The extent of both inSIRS and ipSIRS, as indicated by biomarkers presented in this patent, also provides clinicians with information on next treatment and management steps. For example, a patient with respiratory distress and a strong biomarker response indicating ipSIRS is likely to be immediately hospitalized, placed on antibiotics and a chest X-ray performed. A patient with respiratory distress and a strong biomarker response indicating inSIRS but not ipSIRS is likely to be hospitalized and chest X-rayed along with other investigative diagnostic procedures, such as MRI, ECG, and angiogram. A patient with respiratory distress with a short history and no inSIRS or ipSIRS is likely to undergo further examination at a local clinic rather than requiring hospitalization.

Again, and as mentioned above, patients presenting to emergency departments often have a fever, which is one (of four) of the clinical signs of inSIRS. Such patients need to be assessed to determine if they have either inSIRS or ipSIRS. Further it is important to determine how sick they are to be able to make a Judgment call on whether to admit the patient or not. Accurate triage decision-making insures that patients requiring hospital treatment are given it, and those that don't are provided with other appropriate services.

Patients in ICU often have inSIRS and ipSIRS and it is important to differentiate these two conditions as treatment regimens differ. In patients with inSIRS it is important to determine the extent of the inflammatory response so that appropriate treatments and management regimens can be put in place. For example, a patient newly determined to have inSIRS that is not extensive may be able to be put on mild medication such a non-steroidal anti-inflammatory. A patient newly determined to have extensive inSIRS (e.g. trauma) may require stronger anti-inflammatory medication such as steroids to reduce the potential impact of the side effects of inflammation (swelling). In patients with ipSIRS it is also important to determine the extent of the inflammatory response to infection so that appropriate treatments and management regimens can be put in place or stopped. For example, for a patient with a persistent strong ipSIRS response the clinician may consider either changing, or adding to, the antibiotic treatment regimen in the absence of traditional bacterial culture and sensitivity results. Further, patients that are known to have had ipSIRS and have been on antimicrobial therapy for an extended period but have since demonstrated (by testing using biomarkers) that they no longer have either an inSIRS or ipSIRS can therefore be safely taken off intravenous antibiotics.

Determining the Severity of ipSIRS

Patients admitted to intensive care (ICU) often have ipSIRS, or develop ipSIRS during their ICU stay. It is known that the severity of sepsis can be considered to be a continuum from less severe, or sepsis, to more severe, or severe sepsis, to the most severe, or septic shock. More severe sepsis (ipSIRS) requires more aggressive, immediate and tailored intervention compared to sepsis (although all are acute conditions). Patients in intensive care with diagnosed ipSIRS are usually administered a number of therapeutic compounds—many of which have opposing actions on the immune system and many of which could be counterproductive depending on the severity of ipSIRS (sepsis, severe sepsis, septic shock). Monitoring intensive care patients on a regular basis with biomarkers of the present invention will allow medical practitioners to determine the severity of ipSIRS (mild, severe or shock) and hence choice of therapies and patient management procedures, and ultimately response to therapy. Information provided by these biomarkers disclosed herein will therefore allow medical practitioners to tailor, modify or cease therapies and/or care to ensure patients survive and spend less time in intensive care. Less time in intensive care leads to considerable savings in medical expenses including through less occupancy time and appropriate use and timing of medications.

First Example Workflow

A first example workflow will now be described. The workflow involves up to seven steps depending upon availability of automated platforms. The assay uses quantitative, real-time determination of the amount of each transcript in the sample based on the detection of fluorescence on a qRT-PCR instrument (e.g. Applied Biosystems 7500 Fast Dx Real-Time PCR Instrument, Applied Biosystems, Foster City, Calif., catalogue number 440685; K082562). Transcripts are each amplified, detected, and quantified in a separate reaction well using a probe that is visualized in the FAM channel (by example). The reported score is calculated using interpretive software provided separately to the kit but designed to integrate with RT-PCR machines.

The workflow below describes the use of manual processing and a pre-prepared kit.

Pre-Analytical
    Blood collection
    Total RNA isolation
Analytical
    Reverse transcription (generation of cDNA)
    qPCR preparation
    qPCR
    Software, Interpretation of Results and Quality Control Output.

Kit Contents
    Diluent
    RT Buffer
    RT Enzyme Mix
    qPCR Buffer
    Primer/Probe Mix
    AmpliTaq Gold® (or similar)
    High Positive Control
    Low Positive Control
    Negative Control Blood Collection The specimen used is a 2.5 mL sample of blood collected by venipuncture using the PAXgene® collection tubes within the PAXgene® Blood RNA System (Qiagen, kit catalogue #762164; Becton Dickinson, Collection Tubes catalogue number 762165; K042613). An alternate collection tube is Tempus® (Life Technologies).

Total RNA Isolation

Blood (2.5 mL) collected into a PAXgene RNA tube is processed according to the manufacturer's instructions. Briefly, 2.5 mL sample of blood collected by venipuncture using the PAXgene™ collection tubes within the PAXgene™ Blood RNA System (Qiagen, kit catalogue #762164; Becton Dickinson, Collection Tubes catalogue number 762165; K042613). Total RNA isolation is performed using the procedures specified in the PAXgene™ Blood RNA kit (a component of the PAXgene™ Blood RNA System). The extracted RNA is then tested for purity and yield (for example by running an $A_{260/280}$ ratio using a Nanodrop® (Thermo Scientific)) for which a minimum quality must be (ratio >1.6). RNA should be adjusted in concentration to allow for a constant input volume to the reverse transcription reaction (below). RNA should be processed immediately or stored in single-use volumes at or below −70° C. for later processing.

Reverse Transcription

Determine the appropriate number of reaction equivalents to be prepared (master mix formulation) based on a plate map and the information provided directly below. Each clinical specimen is run in singleton.
    a) Each batch run must include the following specimens:
    b) High Control, Low Control, Negative Control, and No Template Control (Test Diluent instead of sample) in singleton each Program the ABI 7500 Fast Dx Instrument as detailed below.
    c) Launch the software.
    d) Click Create New Document
    e) In the New Document Wizard, select the following options:
        i) Assay: Standard Curve (Absolute Quantitation)
        ii) Container: 96-Well Clear
        iii) Template: Blank Document (or select a laboratory-defined template)
        iv) Run Mode: Standard 7500
        v) Operator: Enter operator's initials
        vi) Plate name: [default]
    f) Click Finish
    g) Select the Instrument tab in the upper left
    h) In the Thermal Cycler Protocol area, Thermal Profile tab, enter the following times:
        i) 25° C. for 10 minutes
        ii) 45° C. for 45 minutes
        iii) 93° C. for 10 minutes
        iv) Hold at 25° C. for 60 minutes In a template-free area, remove the test Diluent and RT-qPCR Test RT Buffer to room temperature to thaw. Leave the RT-qPCR Test RT Enzyme mix in the freezer and/or on a cold block.

In a template-free area, assemble the master mix in the order listed below.

RT Master Mix—Calculation:

|  | Per well | ×N |
| --- | --- | --- |
| RT-qPCR Test RT Buffer | 3.5 µL | 3.5 × N |
| RT-qPCR Test RT Enzyme mix | 1.5 µL | 1.5 × N |
| Total Volume | 5 µL | 5 × N |

Gently vortex the master mix then pulse spin. Add the appropriate volume (5 µL) of the RT Master Mix into each well at room temperature.

Remove clinical specimens and control RNAs to thaw. (If the specimens routinely take longer to thaw, this step may be moved upstream in the validated method.)

Vortex the clinical specimens and control RNAs, then pulse spin. Add 10 µL of control RNA or RT-qPCR Test Diluent to each respective control or negative well.

Add 10 µL of sample RNA to each respective sample well (150 ng total input for RT; $OD_{260}/OD_{280}$ ratio greater than 1.6). Add 10 µL of RT-qPCR Test Diluent to the respective NTC well.

Note: The final reaction volume per well is 15 µL.

|  | Samples |
| --- | --- |
| RT Master Mix | 5 µL |
| RNA sample | 10 µL |
| Total Volume (per well) | 15 µL |

Mix by gentle pipetting. Avoid forming bubbles in the wells.

Cover wells with a seal.

Spin the plate to remove any bubbles (1 minute at 400× g).

Rapidly transfer to ABI 7500 Fast Dx Instrument preprogrammed as detailed above.

Click Start. Click Save and Continue. Before leaving the instrument, it is recommended to verify that the run started successfully by displaying a time under Estimated Time Remaining.

qPCR master mix may be prepared to coincide roughly with the end of the RT reaction. For example, start about 15 minutes before this time. See below.

When RT is complete (i.e. resting at 25° C.; stop the hold at any time before 60 minutes is complete), spin the plate to collect condensation (1 minute at 400× g).

qPCR Preparation

Determine the appropriate number of reaction equivalents to be prepared (master mix formulation) based on a plate map and the information provided in RT Preparation above.

Figure 14:
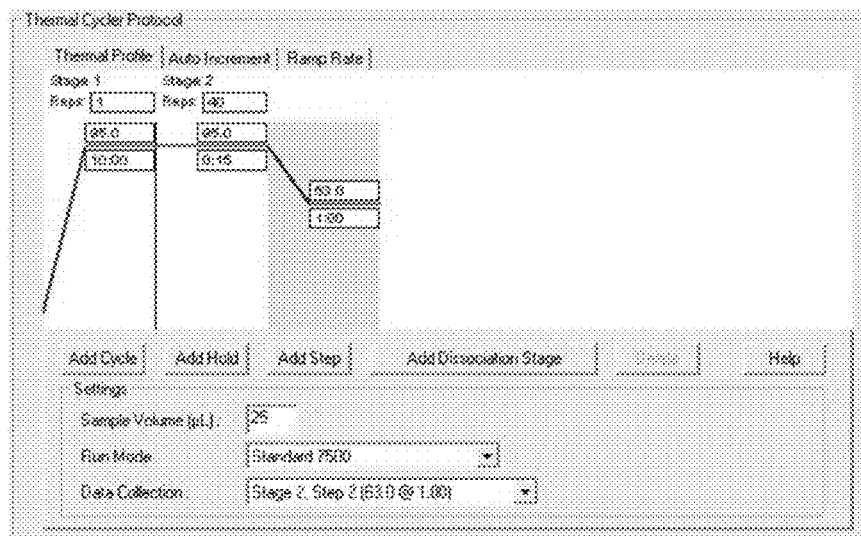
FIG. 14 is a user interface illustrating an example of a thermal cycler protocol.

Program the ABI 7500 Fast Dx with the settings below.
a) Launch the software.
b) Click Create New Document
c) In the New Document Wizard, select the following options:
  i) Assay: Standard Curve (Absolute Quantitation)
  ii) Container: 96-Well Clear
  iii) Template: Blank Document (or select a laboratory-defined template)
  iv) Run Mode: Standard 7500
  v) Operator: Enter operator's initials
  vi) Plate name: Enter desired file name
d) Click Next
e) In the Select Detectors dialog box:
  i) Select the detector for the first biomarker, and then click Add>>.
  ii) Select the detector second biomarker, and then click Add>>, etc.
  iii) Passive Reference: ROX
f) Click Next
g) Assign detectors to appropriate wells according to plate map.
  i) Highlight wells in which the first biomarker assay will be assigned
  ii) Click use for the first biomarker detector
  iii) Repeat the previous two steps for the other biomarkers
  iv) Click Finish
h) Ensure that the Setup and Plate tabs are selected
i) Select the Instrument tab in the upper left
j) In the Thermal Cycler Protocol area, Thermal Profile tab, perform the following actions, with the results shown in FIG. 14:
  i) Delete Stage 1 (unless this was completed in a laboratory-defined template).
  ii) Enter sample volume of 25 µL.
  iii) 95° C. 10 minutes
  iv) 40 cycles of 95° C. for 15 seconds, 63° C. for 1 minute
  v) Run Mode: Standard 7500
  vi) Collect data using the "stage 2, step 2 (63.0@1:00)" setting
k) Label the wells as below using this process: Right click over the plate map, then select Well Inspector. With the Well Inspector open, select a well or wells. Click back into the Well Inspector and enter the Sample Name. Close the Well Inspector when completed.
  i) CONH for High Control
  ii) CONL for Low Control
  iii) CONN for Negative Control
  iv) NTC for No Template Control
  v) [Accession ID] for clinical specimens
l) Ensure that detectors and quenchers are selected as listed below.
  i) FAM for CEACAM biomarker 1; quencher=none
  ii) FAM for LAMP1 biomarker 2; quencher=none, etc.
  iii) FAM for PLA2G7; quencher=none
  iv) FAM for PLACE; quencher=none
  v) Select "ROX" for passive reference qPCR In a template-free area, remove the assay qPCR Buffer and assay Primer/Probe Mixes for each target to room temperature to thaw. Leave the assay AmpliTaq Gold in the freezer and/or on a cold block.

Still in a template-free area, prepare qPCR Master Mixes for each target in the listed order at room temperature.

qPCR Master Mixes—Calculation Per Sample

|  | Per well | ×N |
| --- | --- | --- |
| qPCR Buffer | 11 µL | 11 × N |
| Primer/Probe Mix | 3.4 µL | 3.4 × N |
| AmpliTaq Gold ® | 0.6 µL | 0.6 × N |
| Total Volume | 15 µL | 15 × N |

Gently mix the master mixes by flicking or by vortexing, and then pulse spin. Add 15 µL of qPCR Master Mix to each well at room temperature.

In a template area, add 130 µL of SeptiCyte Lab Test Diluent to each cDNA product from the RT Reaction. Reseal the plate tightly and vortex the plate to mix thoroughly.

Add 10 µL of diluted cDNA product to each well according to the plate layout.

Mix by gentle pipetting. Avoid forming bubbles in the wells.

Cover wells with an optical seal.

Spin the plate to remove any bubbles (1 minute at 400× g).

Place on real-time thermal cycler pre-programmed with the settings above.

Click Start. Click Save and Continue. Before leaving the instrument, it is recommended to verify that the run started successfully by displaying a time under Estimated Time Remaining.

Note: Do not open the qPCR plate at any point after amplification has begun. When amplification has completed, discard the unopened plate.

Software, Interpretation of Results and Quality Control

Software is specifically designed to integrate with the output of PCR machines and to apply an algorithm based on the use of multiple biomarkers. The software takes into account appropriate controls and reports results in a desired format.

When the run has completed on the ABI 7500 Fast Dx Instrument, complete the steps below in the application 7500 Fast System with 21 CFR Part 11 Software, ABI software SDS v1.4.

Click on the Results tab in the upper left corner.

Click on the Amplification Plot tab in the upper left corner.

In the Analysis Settings area, select an auto baseline and manual threshold for all targets. Enter 0.01 as the threshold.

Click on the Analyze button on the right in the Analysis Settings area.

From the menu bar in the upper left, select File then Close.

Complete the form in the dialog box that requests a reason for the change. Click OK.

Transfer the data file (.sds) to a separate computer running the specific assay RT-qPCR Test Software.

Launch the assay RT-qPCR Test Software. Log in.

From the menu bar in the upper left, select File then Open.

Browse to the location of the transferred data file (.sds). Click OK.

The data file will then be analyzed using the assay's software application for interpretation of results.

Interpretation of Results and Quality Control

Results

Launch the interpretation software. Software application instructions are provided separately.

Following upload of the .sds file, the Software will automatically generate classifier scores for controls and clinical specimens.

Controls

The Software compares each CON (control) specimen (CONH, CONL, CONN) to its expected result. The controls are run in singleton.

| Control specimen | | |
|---|---|---|
| Designation | Name | Expected result |
| CONH | High Control | Score range |
| CONL | Low Control | Score range |
| CONN | Negative Control | Score range |
| NTC | No Template Control | Fail (no Ct for all targets) |

If CONH, CONL, and/or CONN fail the batch run is invalid and no data will be reported for the clinical specimens. This determination is made automatically by the interpretive software. The batch run should be repeated starting with either a new RNA preparation or starting at the RT reaction step.

If NTC yields a result other than Fail (no Ct for all targets), the batch run is invalid and no data may be reported for the clinical specimens. This determination is made by visual inspection of the run data. The batch run should be repeated starting with either a new RNA preparation or starting at the RT reaction step.

If a second batch run fails, please contact technical services. If both the calibrations and all controls are valid, then the batch run is valid and specimen results will be reported.

Specimens

Note that a valid batch run may contain both valid and invalid specimen results.

Analytical criteria (e.g. Ct values) that qualify each specimen as passing or failing (using pre-determined data) are called automatically by the software.

Scores out of range—reported.

Quality Control

Singletons each of the Negative Control, Low Positive Control, and High Positive Control must be included in each batch run. The batch is valid if no flags appear for any of these controls.

A singleton of the No Template Control is included in each batch run and Fail (no Ct for all targets) is a valid result indicating no amplifiable material was detectable in the well.

The negative control must yield a Negative result. If the negative control is flagged as Invalid, then the entire batch run is invalid.

The low positive and high positive controls must fall within the assigned ranges. If one or both of the positive controls are flagged as Invalid, then the entire batch run is invalid.

Example Output

Figure 15:
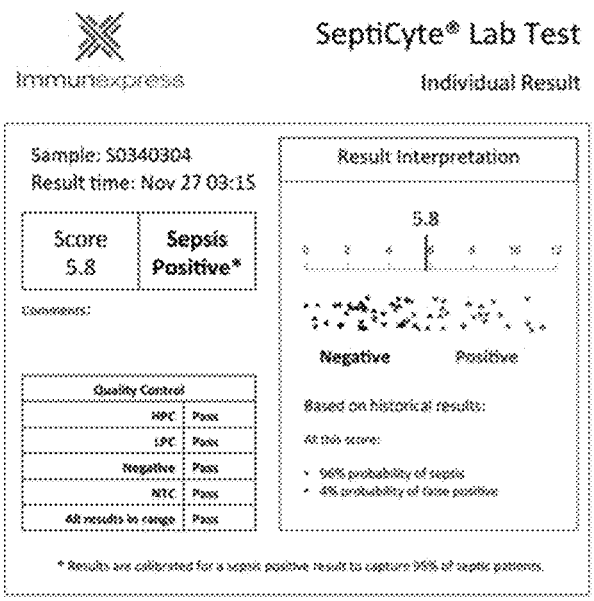
FIG. 15 is a diagram of an example of a report.
Figure 16A:
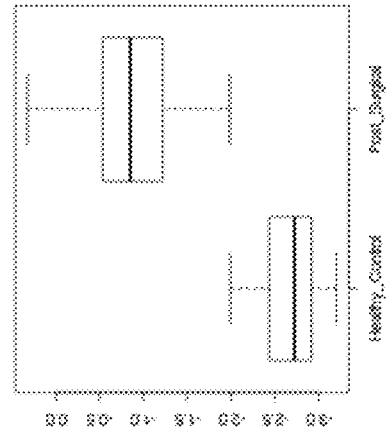
FIGS. 16A to 16L are box and whisker plots for the top twelve biomarker combinations for distinguishing between healthy condition and PS.
Figure 16B:
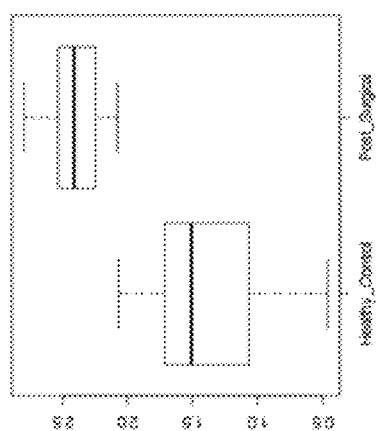
Figure 16C:
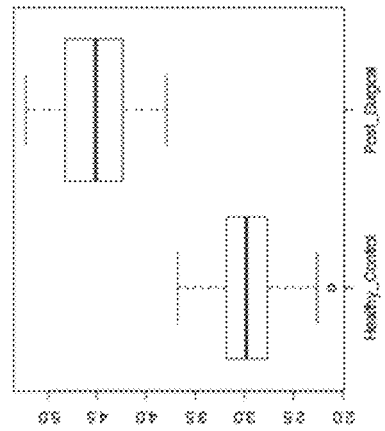
Figure 16D:
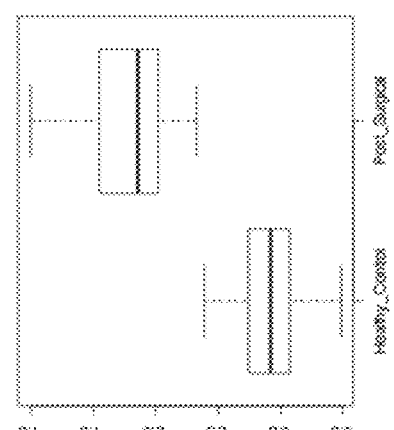
Figure 16E:
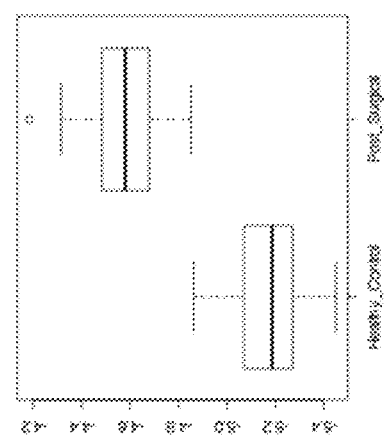
Figure 16F:
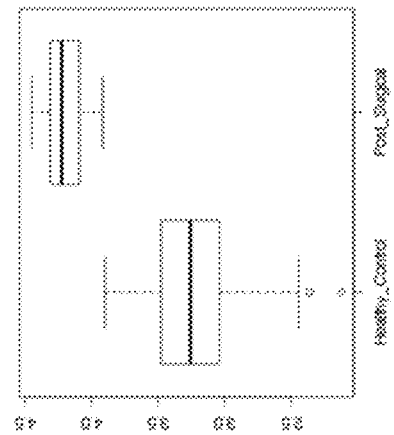
Figure 16G:
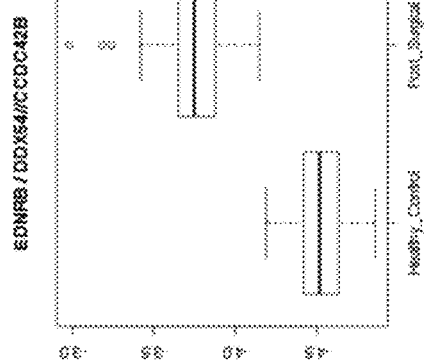
Figure 16H:
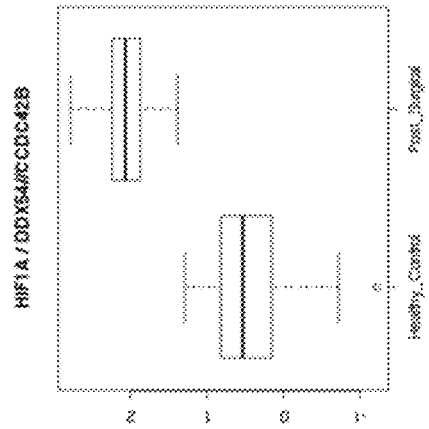
Figure 16I:
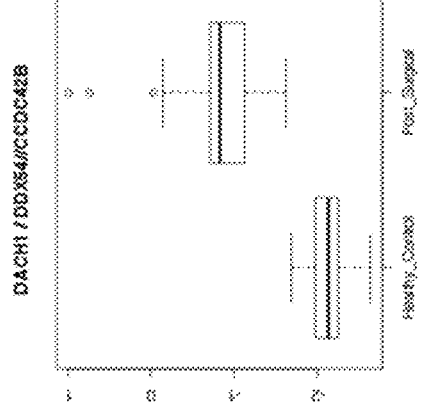
Figure 16J:
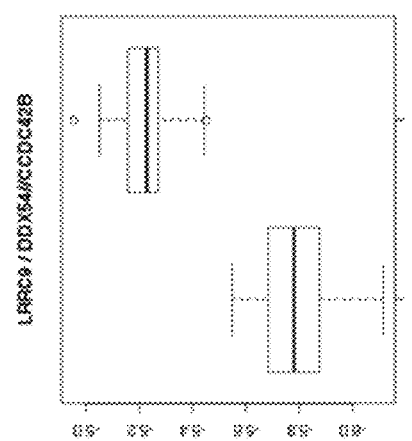
Figure 16K:
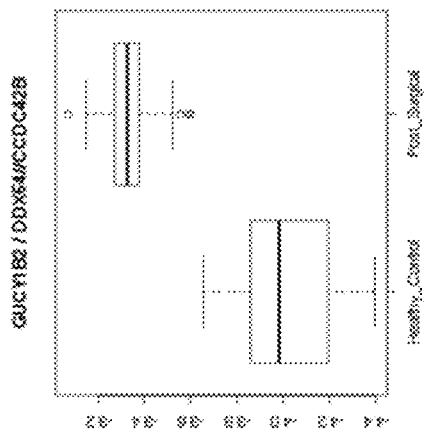
Figure 16L:
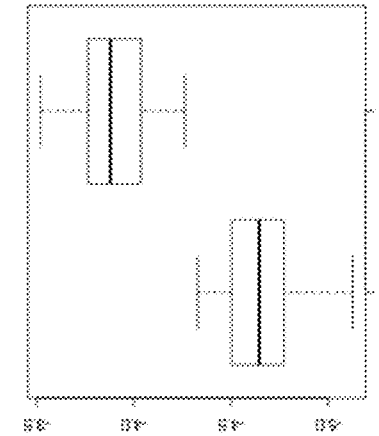
Figure 17A:
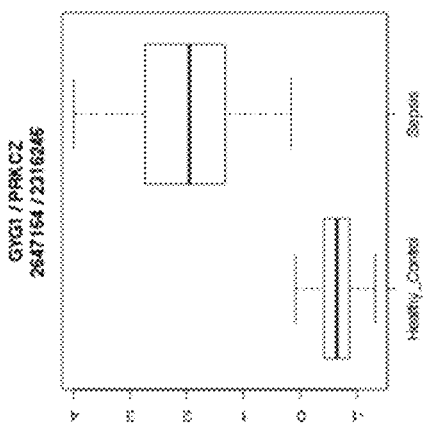
Figure 17B:
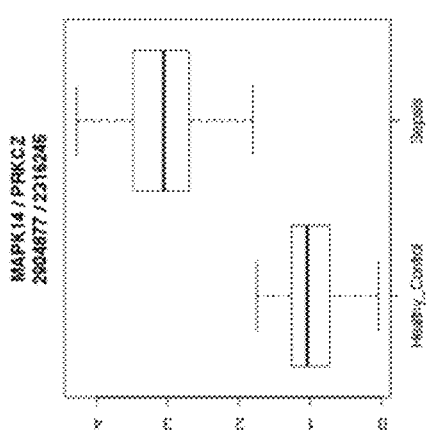
Figure 17C:
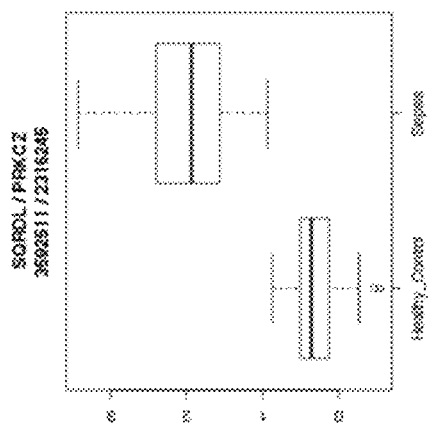
Figure 17E:
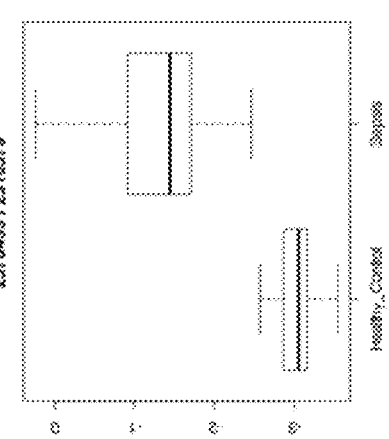
Figure 17F:
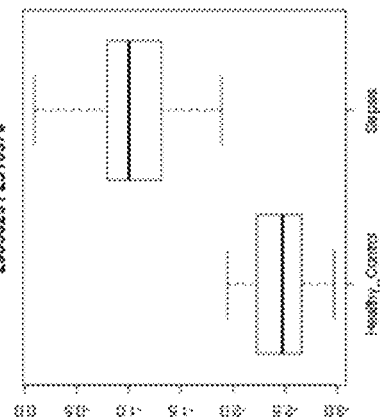
Figure 17I:
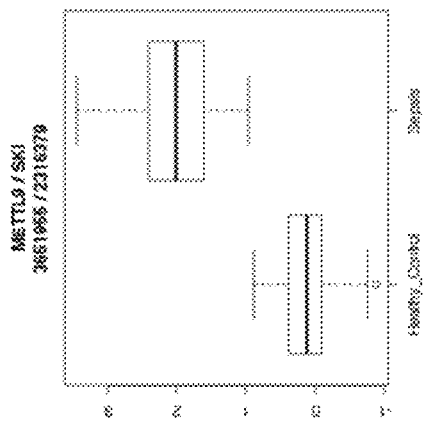
Figure 17L:
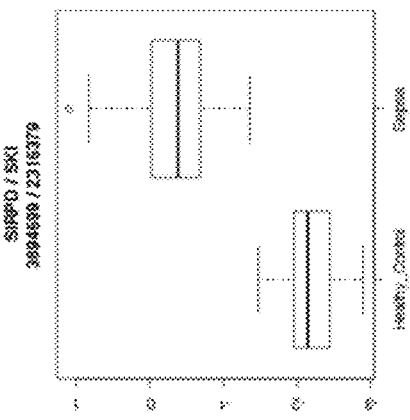
Figure 17H:
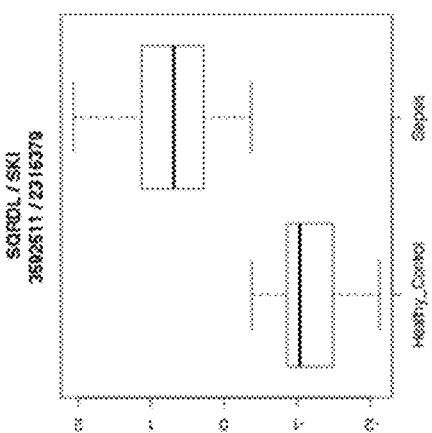
Figure 17K:
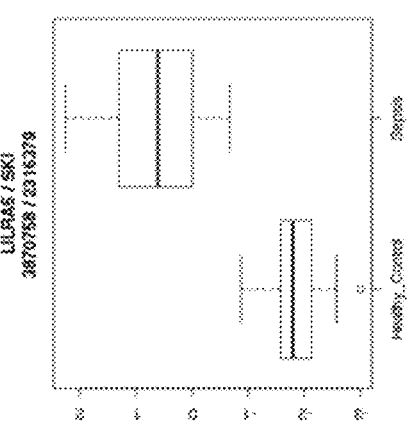
Figure 17G:
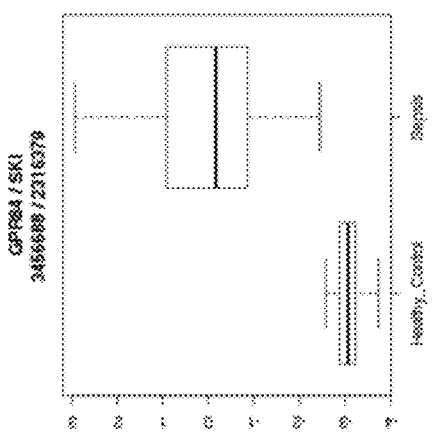
Figure 18A:
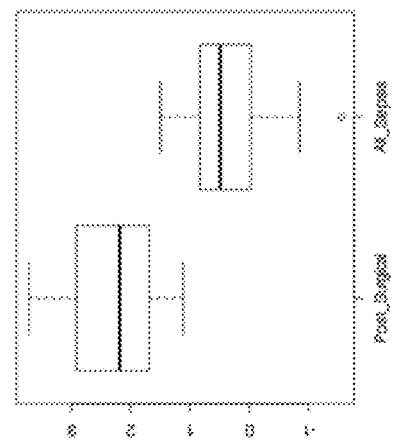
FIGS. 18A to 18L are box and whisker plots for the top twelve biomarker combinations for distinguishing between PS and sepsis.
Figure 18B:
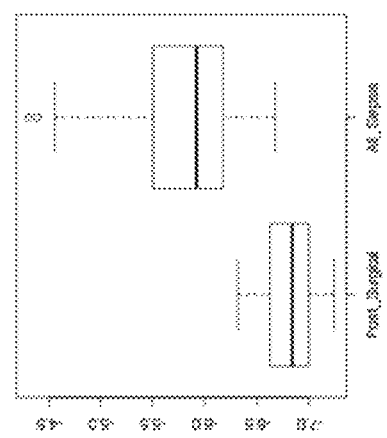
Figure 18C:
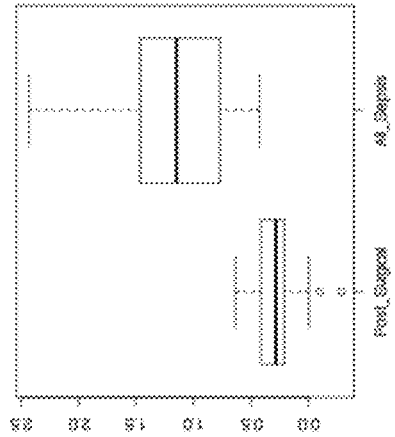
Figure 18D:
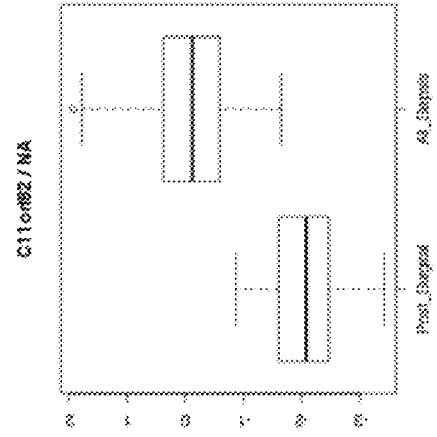
Figure 18E:
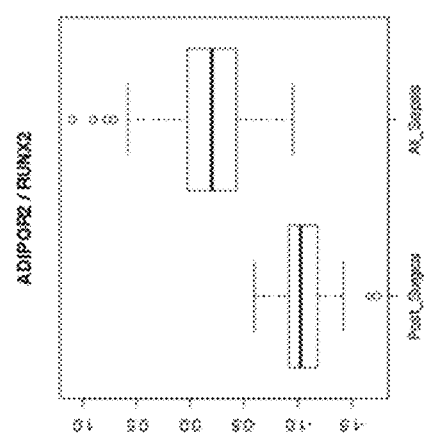
Figure 18F:
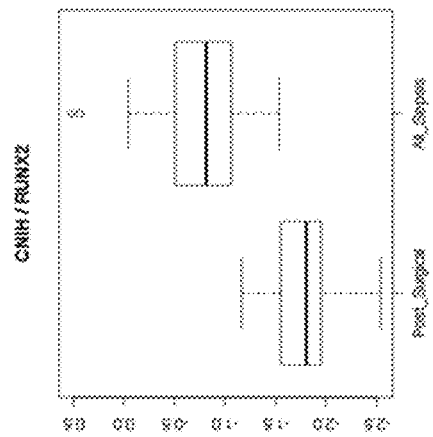
Figure 18I:
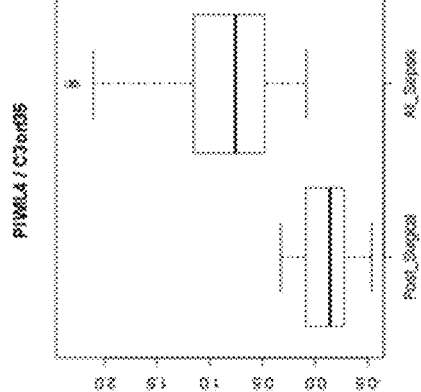
Figure 18L:
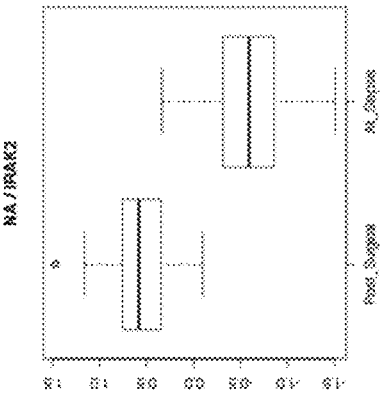
Figure 18H:
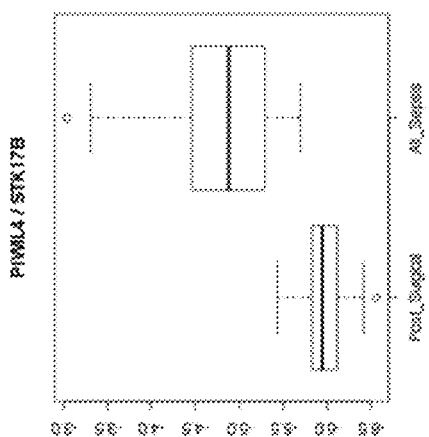
Figure 18K:
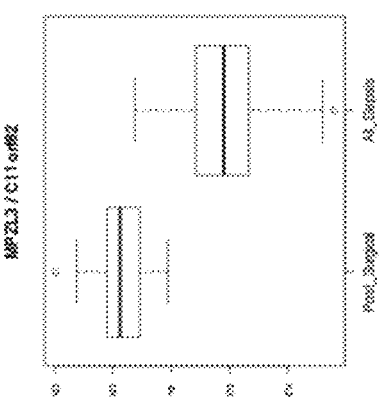
Figure 18G:
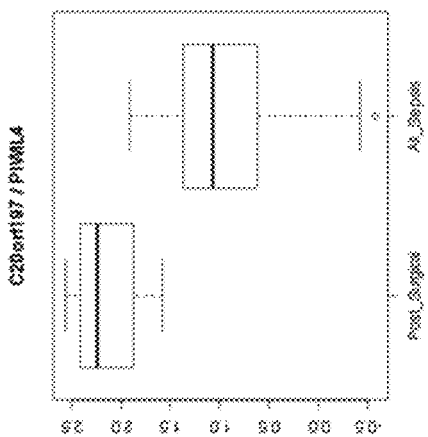
Figure 18J:
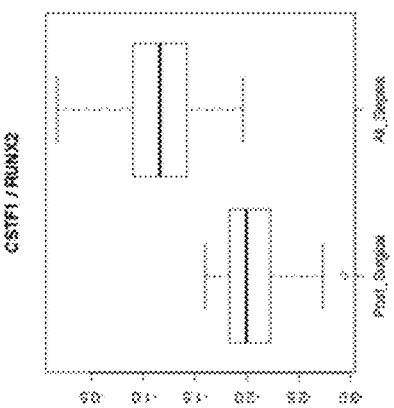
Figure 19A:
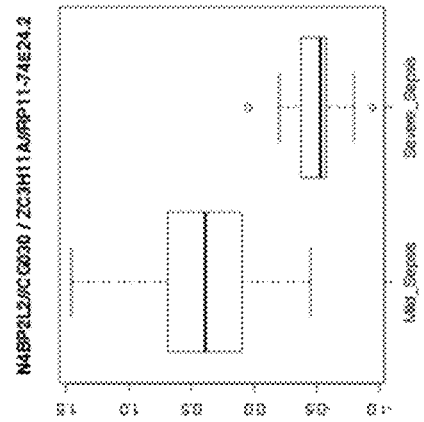
FIGS. 19A to 19L are box and whisker plots for the top twelve biomarker combinations for distinguishing between sepsis and severe sepsis.
Figure 19B:
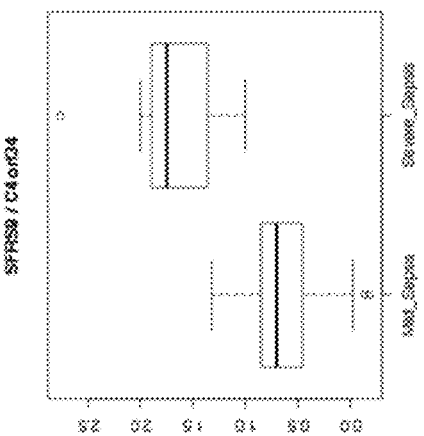
Figure 19C:
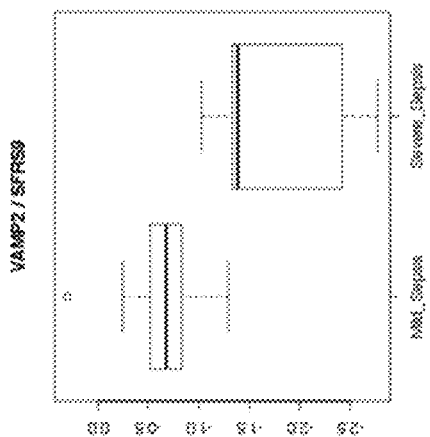
Figure 19D:
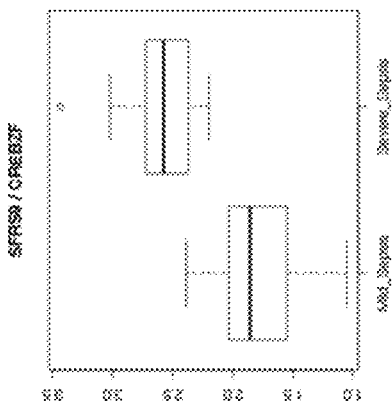
Figure 19E:
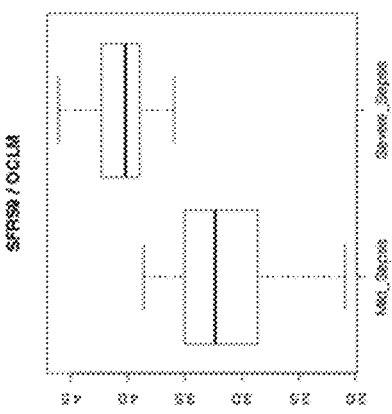
Figure 19F:
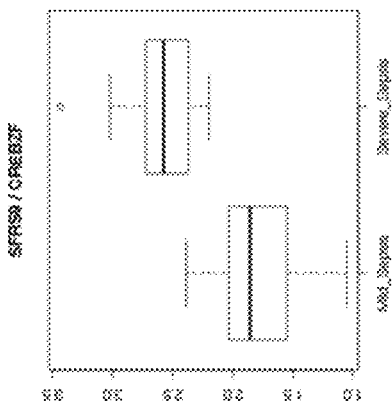
Figure 19I:
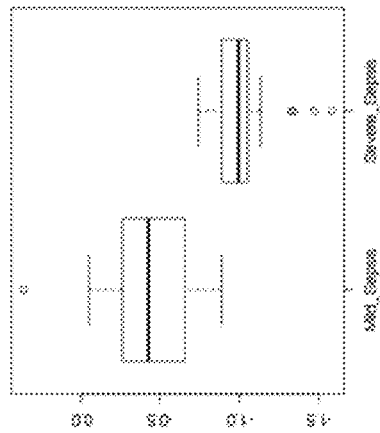
Figure 19L:
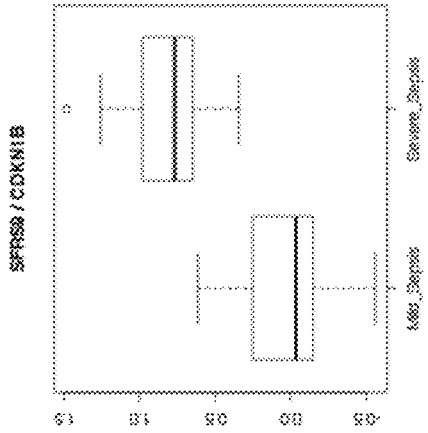
Figure 19H:
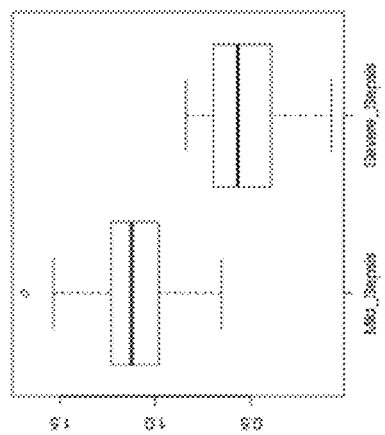
Figure 19K:
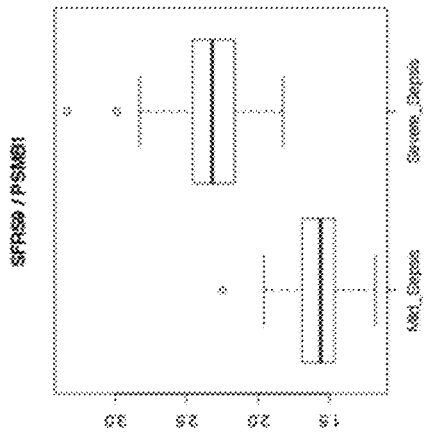
Figure 19G:
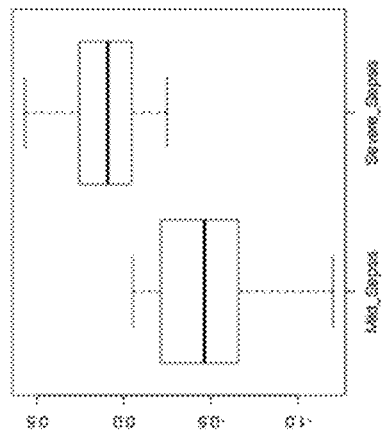
Figure 19J:
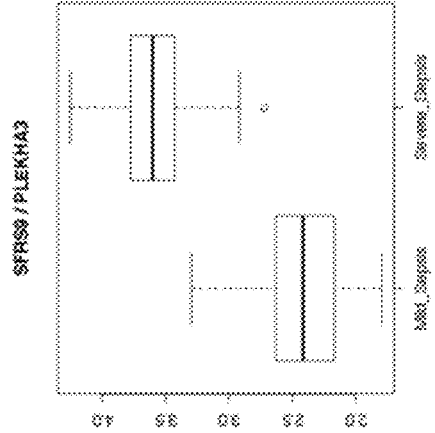
Figure 20A:
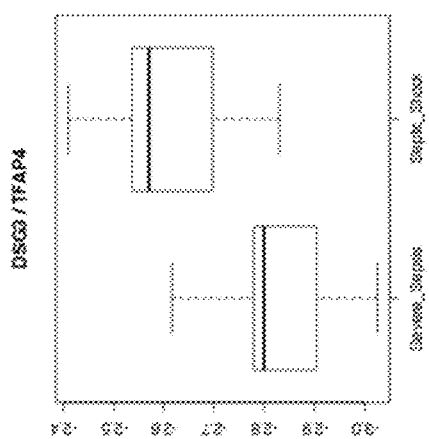
FIGS. 20A to 20L are box and whisker plots for the top twelve biomarker combinations for distinguishing between severe sepsis and septic shock.
Figure 20B:
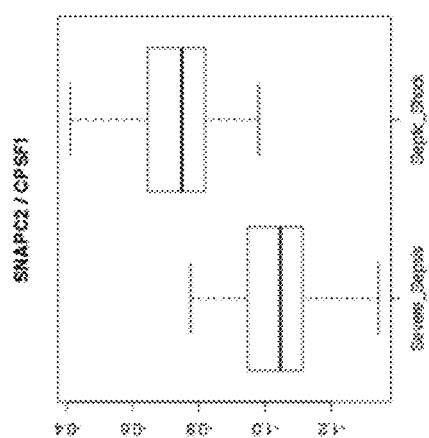
Figure 20C:
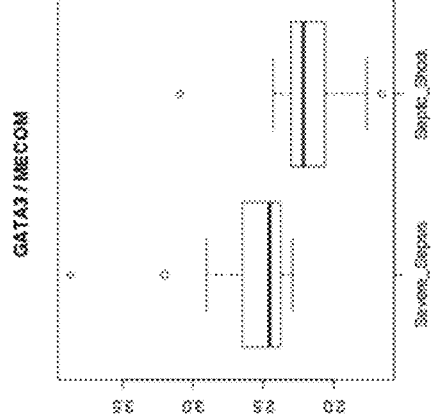
Figure 20D:
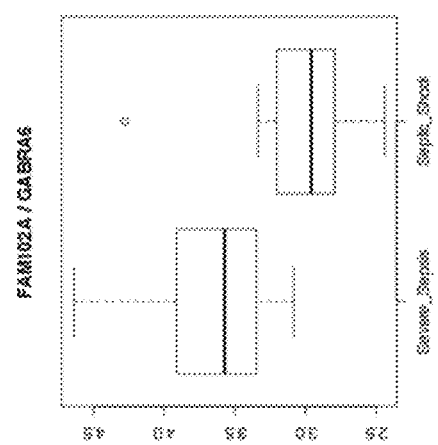
Figure 20E:
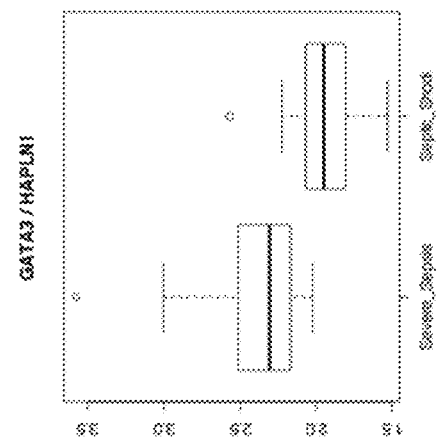
Figure 20F:
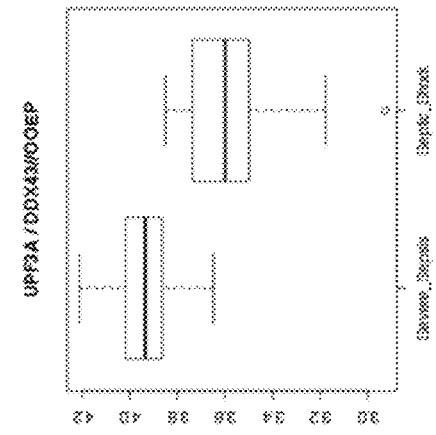
Figure 20G:
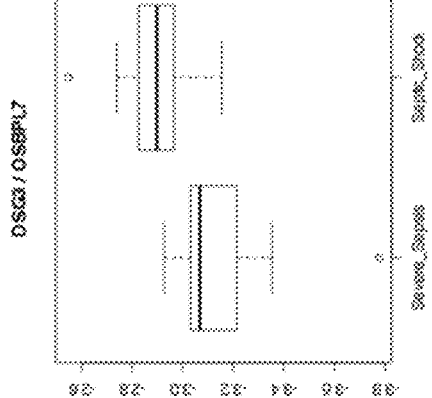
Figure 20J:
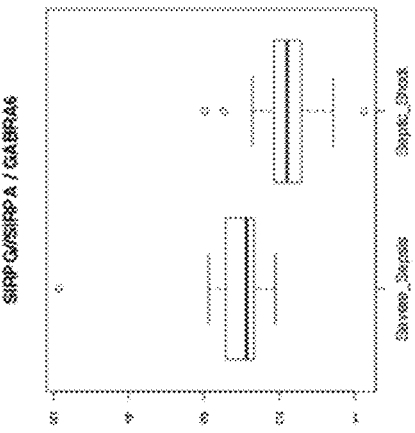
Figure 20H:
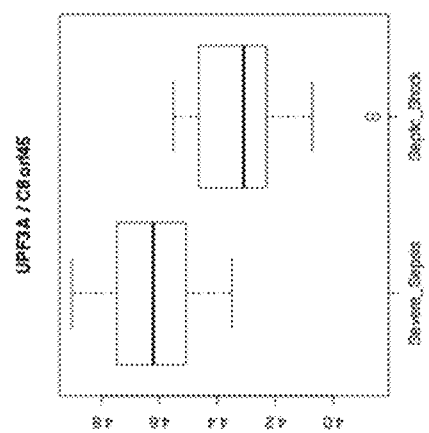
Figure 20K:
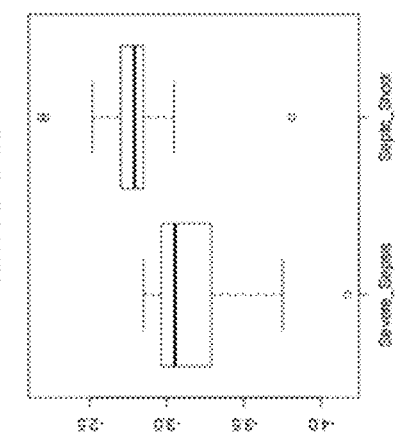
Figure 20I:
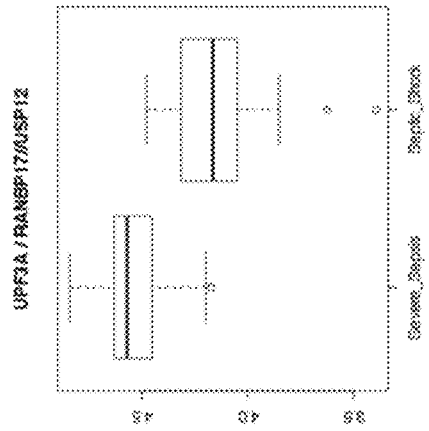
Figure 20L:
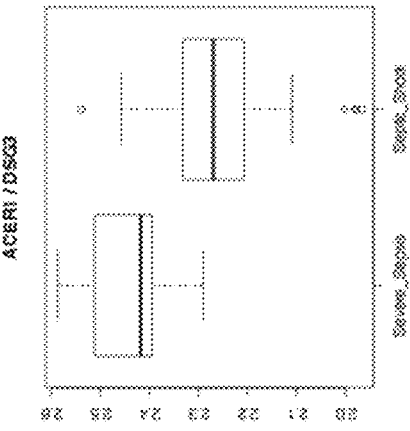
Figure 21A:
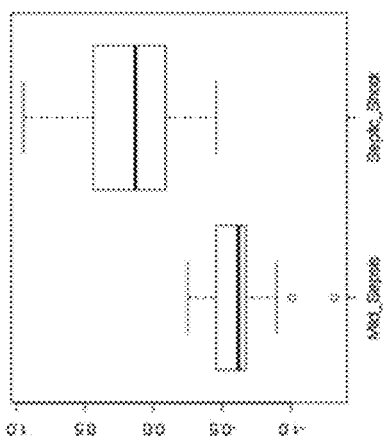
FIGS. 21A to 21L are box and whisker plots for the top twelve biomarker combinations for distinguishing between sepsis and septic shock.
Figure 21B:
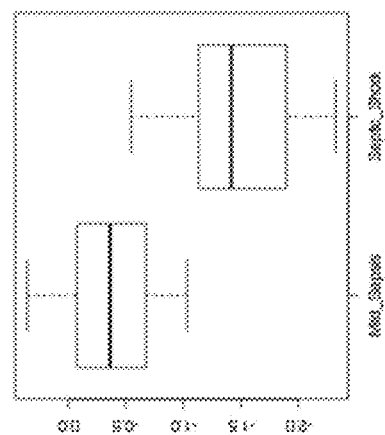
Figure 21C:
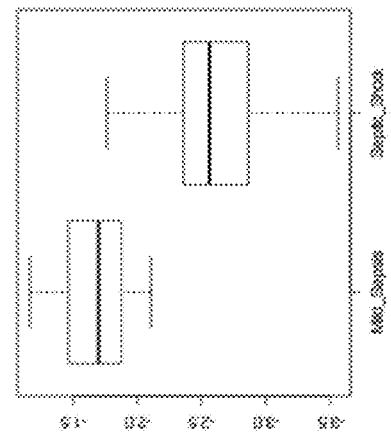
Figure 21D:
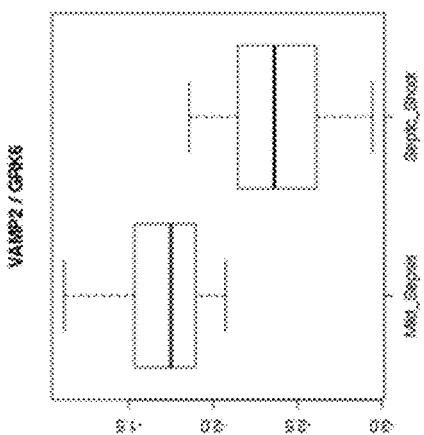
Figure 21E:
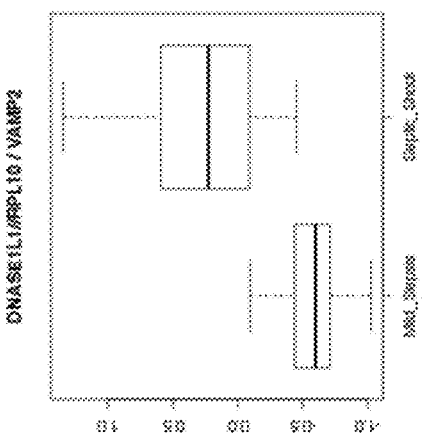
Figure 21F:
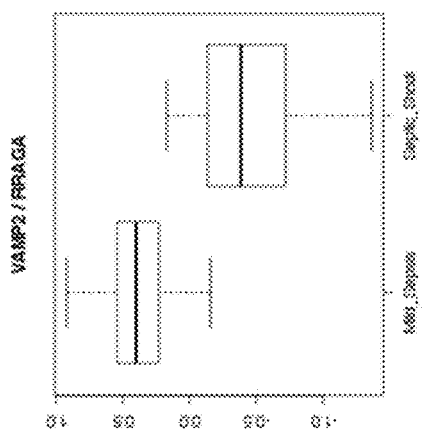
Figure 21G:
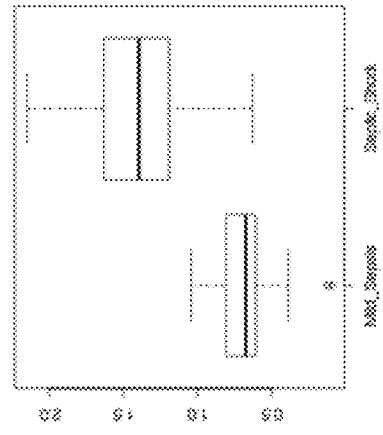
Figure 21H:
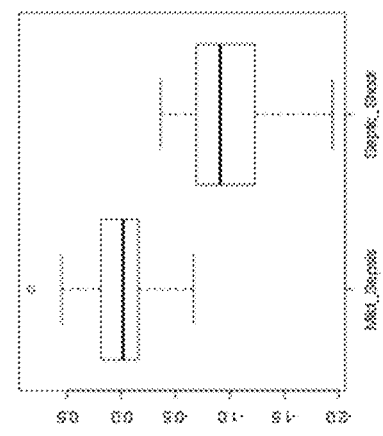
Figure 21I:
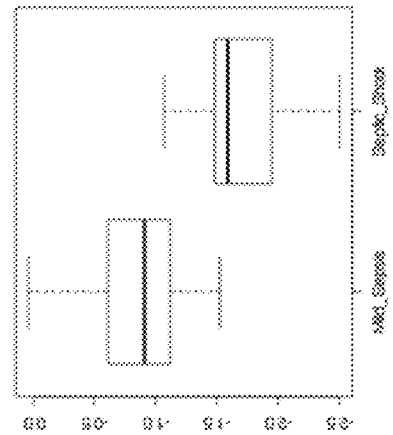
Figure 21J:
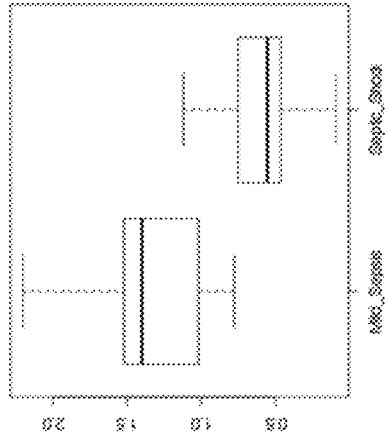
Figure 21K:
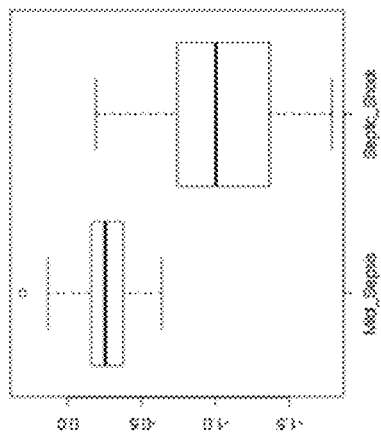
Figure 21L:
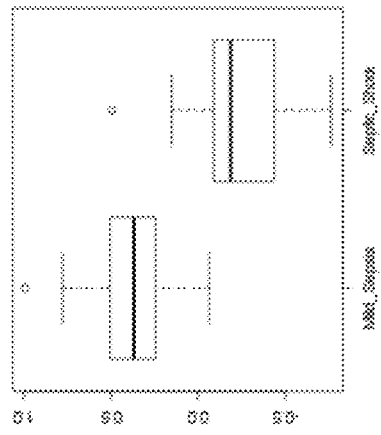

A possible example output from the software is presented below in FIG. 15. The format of such a report depends on many factors including; quality control, regulatory authorities, cut-off values, the algorithm used, laboratory and clinician requirements, likelihood of misinterpretation.

In this instance the assay is called "SeptiCyte Lab Test". The result is reported as a number (5.8), a call ("Sepsis Positive"), a position on a 0-12 scale, and a probability of the patient having sepsis based on historical results and the use of a pre-determined cut-off (using results from clinical trials). Results of controls within the assay are also reported. Other information that could be reported might include: previous results and date and time of such results, probability of severe sepsis or septic shock, a scale that provides cut-off values for historical testing results that separate the conditions of healthy, inSIRS and ipSIRS (mild, severe and shock) such that those patients with higher scores are considered to have more severe inSIRS or ipSIRS.

Second Example Workflow

A second example workflow will now be described. Machines have been, and are being, developed that are capable of processing a patient sample at point-of-care, or near point-of-care. Such machines require few molecular biology skills to run and are aimed at non-technical users. The idea is that the sample would be pipetted directly into a disposable cartridge that is then inserted into the machine. The user presses "Start" and within 2-3 hours a result is generated. The cartridge contains all of the required reagents to perform Steps 2-5 in the example workflow above and the machine has appropriate software incorporated to allow Steps 6 and 7 to be performed.

Fresh, whole, anti-coagulated blood can be pipetted into an Idylla Cartridge (Biocartis NV) or similar (Unyvero, Curetis AG; Enigma ML, Enigma Diagnostics; DiagCore, STAT Diagnostica; Savannah, Quidel Corp; ePlex, GenMark Dx), and on-screen instructions on the Idylla machine followed to test for differentiating inSIRS and ipSIRS (by example). Inside the Idylla machine RNA is first extracted from the whole blood and is then converted into cDNA. The cDNA is then used in qRT-PCR reactions. The reactions are followed in real time and Ct values calculated. On-board software generates a result output (see Figure XX). Appropriate quality control measures for RNA quality, no template controls, high and low template controls and expected Ct ranges ensure that results are not reported erroneously.

Example Biomarker Ratios

Example biomarker ratios (the top 12 based on AUC) that are capable of separating different conditions are shown in the box and whisker plots as listed below, with each showing perfect separation.

FIGS. 16A to 16L show Healthy Versus inSIRS (Post-Surgical)
FIGS. 17A to 17L show Healthy Versus ipSIRS (Sepsis)
FIGS. 18A to 18L show inSIRS (Post-Surgical) Versus ipSIRS (Sepsis)
FIGS. 19A to 19L show Sepsis Versus Severe Sepsis
FIGS. 20A to 20L show Severe Sepsis Versus Septic Shock
FIGS. 21A to 21L show Sepsis Versus Septic Shock Example Algorithm Combining Biomarker Ratios Biomarker ratios (derived markers) can be used in combination to increase the diagnostic power for separating various conditions. Determining which markers to use, and how many, for separating various conditions can be achieved by calculating Area Under Curve (AUC).

Figure 22:
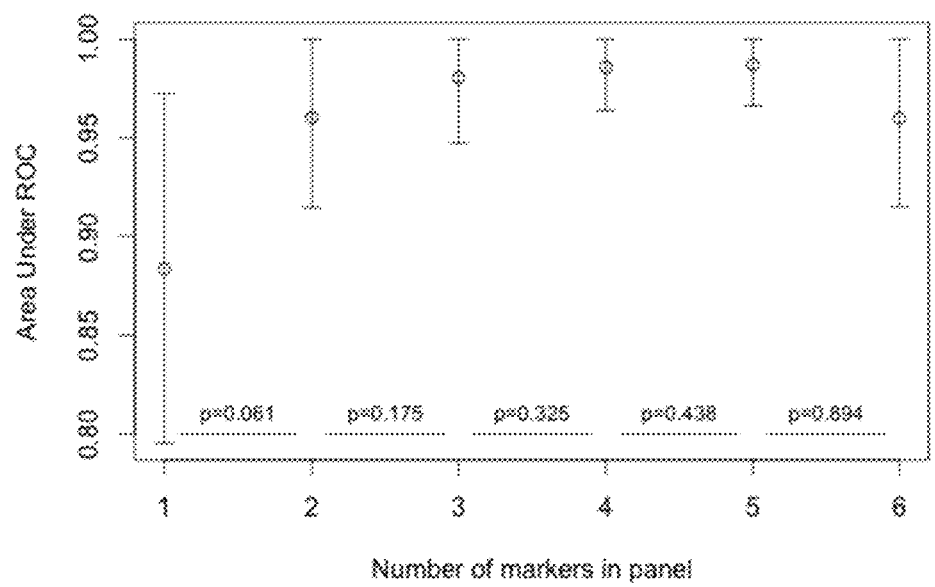
FIG. 22 is a graph of the effect on AUC of adding biomarkers to a biomarker signature.

FIG. 22 shows the effect on AUC (in this instance for separating inSIRS and ipSIRS) of adding biomarkers to the diagnostic signature. Diagnostic power significantly increases (adjusted p-value=0.0175) between a single mRNA biomarker (in this instance PLA2G7, AUC of 0.88, 95% CI 0.79-0.97) compared to the power of the two best performing markers in combination (in this instance PLA2G7 and PLAC8, AUC of 0.96, 95% CI 0.91-1.0). Combinations of two, three, four and five biomarkers produced equally as good differentiation of inSIRS and ipSIRS without significant differences. For commercial development of derived markers other factors come into play such as cost-effectiveness, assay complexity and capabilities of the qRT-PCR platform.

In this example, the addition of markers beyond 3 or 4 does not significantly improve performance and, conversely, a decline in AUC is observed in signatures of >5 genes probably because when a statistical model is forced to include biomarkers that add little additional information data over-fitting and addition of noise occurs.

As such, and by example, a 4-gene signature (0.986, 95% CI 0.964-1.00) offers the appropriate balance between simplicity, practicality and commercial risk for separating inSIRS and ipSIRS. Further, an equation using four markers weighs each biomarker equally which also provides additional robustness in cases of analytical or clinical variability.

One example equation that provides good diagnostic power for separating inSIRS and ipSIRS (amongst others) is:

$$\text{Diagnostic Score} = (PLA2G7 - PLAC8) + (CEACAM4 - LAMP1)$$

The value for each biomarker is a Ct value from a PCR. When clinical samples from patients with inSIRS and ipSIRS were tested using these four markers in a PCR the Ct values for each of the markers was found to fall between 26 and 34. In this patient population the first biomarker within each bracket pair has a higher value than the second biomarker within each bracket pair. Thus, the "Diagnostic Score" has been found to have values between 0 and 12. However, in theory the "Diagnostic Score could potentially be highest Ct value +/− highest Ct value.

Figure 23:
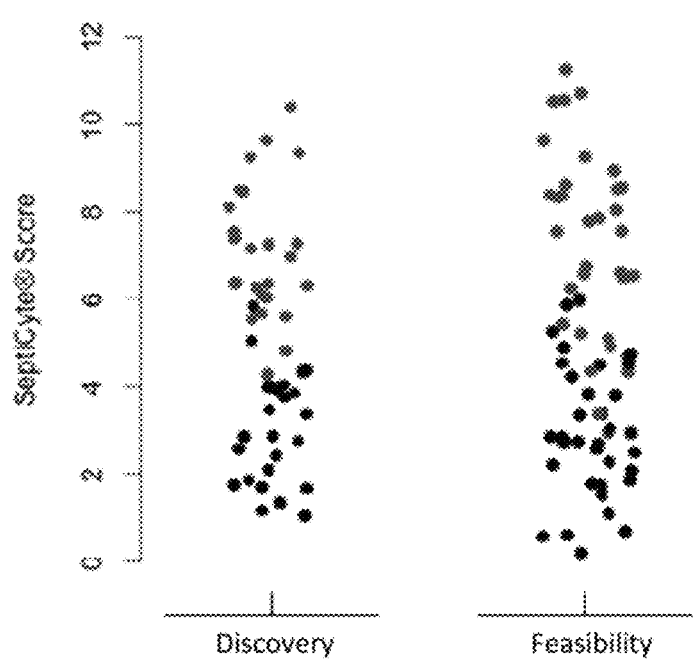
FIG. 23 is a graph showing an example of the ability of the biomarker signature to distinguish between PS and sepsis for two patient populations.

In FIG. 23 shows results of PCR and the use of the above algorithm have been calculated for two patient populations (N=63 for "Discovery" and N=70 for "Feasibility"). Each patient was clinically and retrospectively (note, not at the time the sample was taken) confirmed as having either inSIRS (black dots) or ipSIRS (red dots). Each patient sample has also had a SeptiCyte score calculated (Y axis on left hand side). On a scale of 0-12 it can be seen that patients with confirmed ipSIRS (red dots) obtain a higher Diagnostic Score compared to those with confirmed inSIRS. Further, it can be seen that an arbitrary cut-off line can be drawn that more or less separates the two conditions depending upon the desired false negative or false positive rate (compared to a retrospective diagnosis of inSIRS or ipSIRS using clinical data). In this instance the line is drawn at a "SeptiCyte Score" of 4 such that the number of false negative ipSIRS calls in the Discovery Dataset is zero and the number of false negative ipSIRS calls in the Feasibility Dataset is 2. Conversely the number of false positive ipSIRS calls in the Discovery Dataset is four and the number of false positive ipSIRS calls in the Feasibility Dataset is 9. Clearly in this instance whether a patient sample is false positive or false negative depends on the artificial gold standard of a retrospective clinical call of inSIRS or ipSIRS.

Accordingly, in one example, when used for determining a likelihood of the subject having inSIRS or ipSIRS, the method can include determining a first pair of biomarker values indicative of a concentration of polynucleotide expression products of the PLA2G7 gene and PLAC8 gene, determining a second pair of biomarker values indicative of a concentration of polynucleotide expression products of the CEACAM4 gene and LAMP1 gene and then determining an indicator using the first and second pairs of biomarker values.

As previously discussed, the indicator could then be compared to indicator references specifically established to distinguish between inSIRS and ipSIRS.

Figure 24:
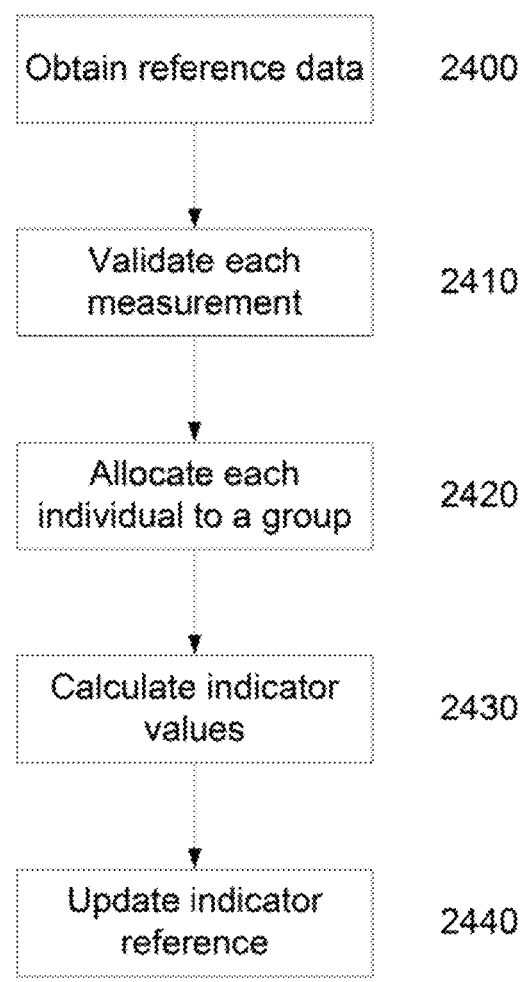
FIG. 24 is a flowchart of an example of a method for determining indicator references.

An example process of a process for establishing indicator references will now be described in more details with reference to FIG. 24.

In this example, at step 2400 the processing system 201 determines reference data in the form of measured biomarker values obtained for a reference population. The reference data may be acquired in any appropriate manner but typically this involves obtaining gene expression product data from a plurality of individuals.

In order to achieve this, gene expression product data are collected, for example by obtaining a biological sample, such as a peripheral blood sample, and then performing a quantification process, such as a nucleic acid amplification process, including PCR (Polymerase Chain Reaction) or the like, in order to assess the activity, and in particular, level or abundance of a number of reference biomarkers. Quantified values indicative of the relative activity are then stored as part of the reference data.

In one example, the measurements are received as raw data, which then undergoes preliminary processing. Such raw data corresponds to information that has come from a source without modification, such as outputs from instruments such as PCR machines, array (e.g., microarray) scanners, sequencing machines, clinical notes or any other biochemical, biological, observational data, or the like. This step can be used to convert the raw data into a format that is better suited to analysis. In one example this is performed in order to normalize the raw data and thereby assist in ensuring the biomarker values demonstrate consistency even when measured using different techniques, different equipment, or the like. Thus, the goal of normalization is to remove the variation within the samples that is not directly attributable to the specific analysis under consideration. For example, to remove variances caused by differences in sample processing at different sites. Classic examples of normalization include z-score transformation for generic data, or popular domain specific normalizations, such as RMA normalization for microarrays.

However, it will also be appreciated that in some applications, such as a single sample experiment run on a single data acquisition machine, this step may not strictly be necessary, in which case the function can be a Null function producing an output identical to the input.

In one example, the preferred approach is a paired function approach over log normalized data. Log normalization is a standard data transformation on microarray data, because the data follow a log-normal distribution when coming off the machine. Applying a log transform turns the data into process-friendly normal data.

The individuals are selected to include individuals diagnosed with one or more conditions of interest, as well as healthy individuals. The conditions are typically medical, veterinary or other health status conditions and may include any illness, disease, stages of disease, disease subtypes, severities of disease, diseases of varying prognoses or the like, and in the current example would include at least some individuals with inSIRS and some individuals with ipSIRS. In this regard, the individuals also typically undergo a clinical assessment allowing the conditions to be clinically identified, and with an indication of any assessment or condition forming part of the reference data.

The biomarker values measured will depend on the predominant condition that is being assessed so, for example, in the case of determining the likelihood of a subject having inSIRS or ipSIRS, the biomarkers used will be LAMP1, CEACAM4, PLAC8 and PLA2G7, as discussed above.

Once collected, the reference data can be stored in the database 211 allowing this to be subsequently retrieved by the processing system 201 for subsequent analysis, or could be provided directly to the processing system 201 for analysis.

As part of the above process, at step 2410 the measurements are validated using traditional prior art techniques, to ensure that the measurements have been performed successfully, and hence are valid.

At step 2420, each individual with the reference population is typically allocated to a group. The groups may be defined in any appropriate manner and may be defined based on any one or more of an indication of a presence, absence, degree, stage, severity, prognosis or progression of a condition, other tests or assays, or measured biomarkers associated with the individuals.

For example, a first selection of groups may be to identify one or more groups of individuals suffering from SIRS, one or more groups of individuals suffering ipSIRS, and one or more groups of individuals suffering inSIRS. Further groups may also be defined for individuals suffering from other conditions. The groups may include overlapping groups, so for example it may be desirable to define groups of healthy individuals and individuals having SIRS, with further being defined to distinguish inSIRS patients from ipSIRS patients, as well as different degree of inSIRS or ipSIRS, with these groups having SIRS in common, but each group of patients differing in whether a clinician has determined the presence of an infection or not. Additionally, further subdivision may be performed based on characteristics of the individuals, phenotypic traits, measurement protocols or the like, so groups could be defined based on these parameters so that a plurality of groups of individuals suffering from a condition are defined, with each group relating to a different phenotypic trait, measurement protocol or the like.

It will also be appreciated, however, that identification of different groups can be performed in other manners, for example on the basis of particular activities of biomarkers within the biological samples of the reference individuals, and accordingly, reference to conditions is not intended to be limiting and other information may be used as required.

The manner in which classification into groups is performed may vary depending on the preferred implementation. In one example, this can be performed automatically by the processing system 201, for example, using unsupervised methods such as Principal Components Analysis (PCA), or supervised methods such as k-means or Self Organizing Map (SOM). Alternatively, this may be performed manually by an operator by allowing the operator to review reference data presented on a Graphical User Interface (GUI), and define respective groups using appropriate input commands.

At step 2430, first and second derived biomarker values are determined representing respective indicator values. The first and second indicator values $In_1, In_2$ are determined on a basis of ratios of concentrations of first and second, and third and fourth biomarkers respectively:

$$In_1 = (PLA2G7/PLAC8)$$

$$In_2 = (CEACAM4/LAMP1)$$

The indicator values are then used to establish indicator references at step 2440, which are then used in analyzing measured indicator values for a subject to establish a likelihood of the subject having a condition.

Figure 26:
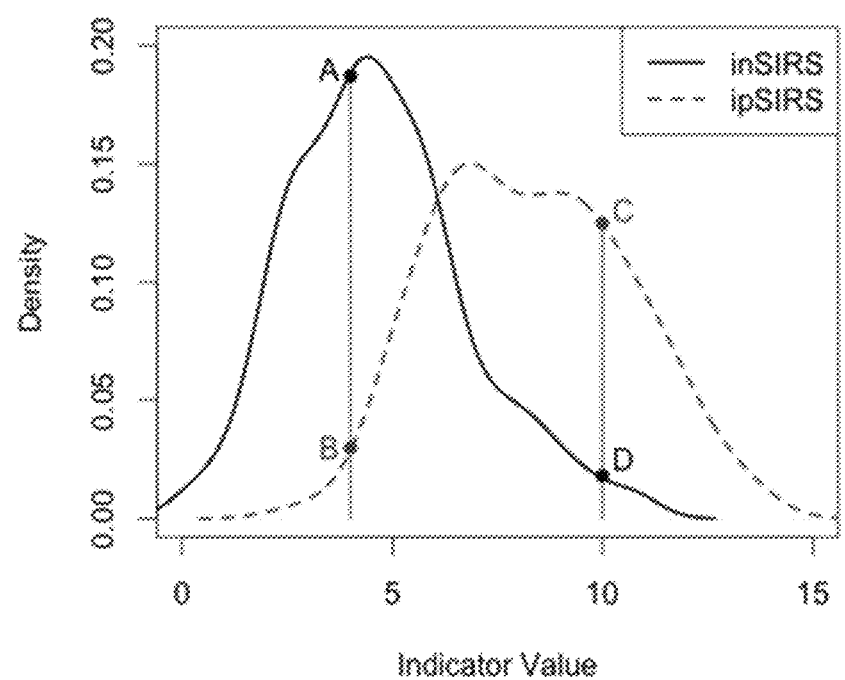
FIG. 26 is an example showing the comparison of an indicator value to an indicator reference; and, FIGS. 27A and 27B are example representation of indicator values.

In particular, indicator values for each reference group are statistically analyzed to establish a range or distribution of indicator values that is indicative of each group, and an example distribution is shown in FIG. 26, as will be discussed in more detail below.

Figure 25A:
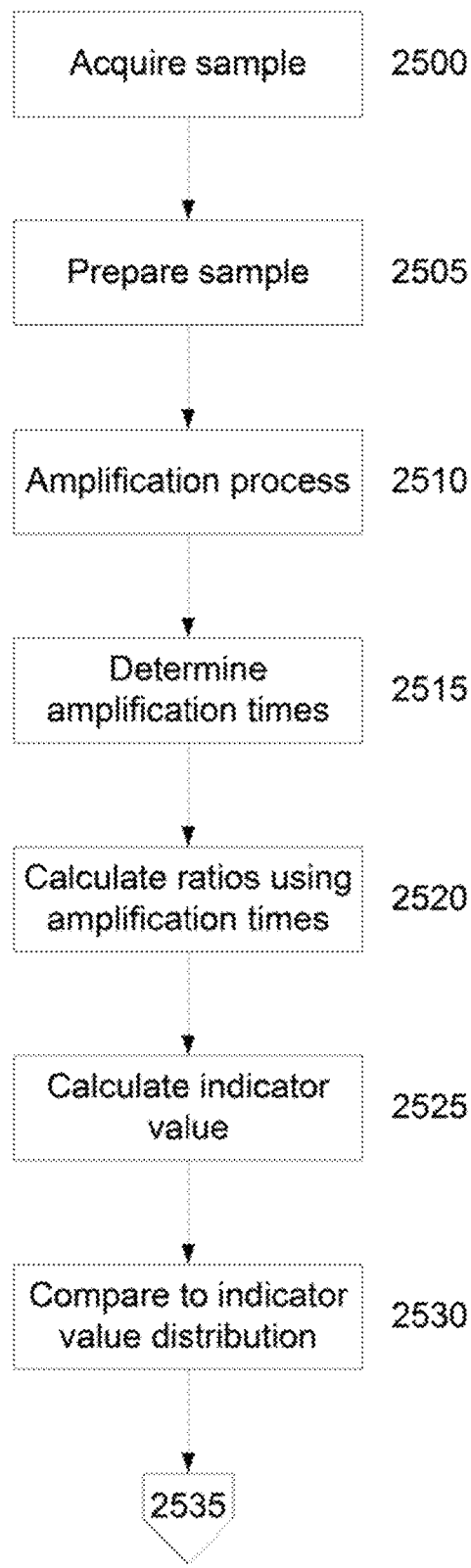
FIGS. 25A and 25B are a flowchart of an example of a method for validating an indicator derived from biomarker measurements.
Figure 25B:
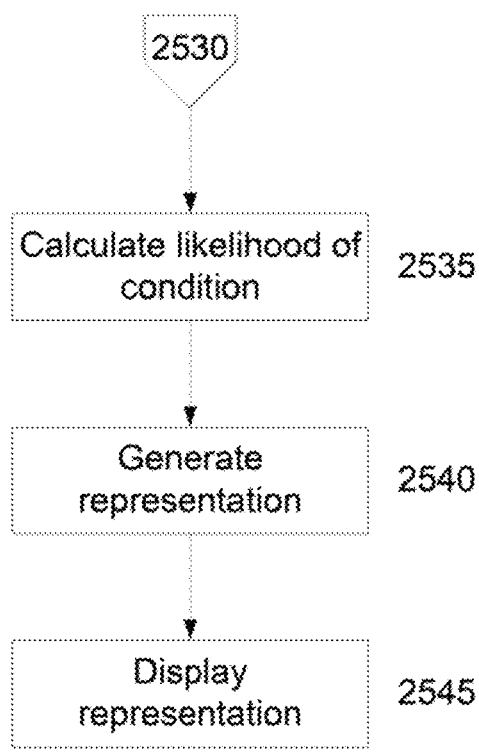

A further example will now be described with reference to FIGS. 25A and 25B.

In this example, at step 2500 a sample is acquired from the subject. The sample could be any suitable sample such as a peripheral blood sample, or the like, depending on the nature of the biomarker values being determined. At step 2505 the sample undergoes preparation allowing this to be provided to a measuring device and used in a quantification process at step 2510. For this purpose of this example, the quantification process involves PCR amplification, with the measuring device being a PCR machine, although other suitable techniques could be used. In this instance, amplifications times At(PLA2G7), At(PLAC8), At(CEACAM4), At(LAMP1) are determined for each of the four biomarkers at step 2515, with the amplification times being transferred from the measuring device to the processing system 201 allowing the processing system 201 to perform analysis of the corresponding biomarker values.

Accordingly, at step 2520 the processing system 201 calculates ratios using the amplifications times. In this regard, as the amplification times represent a log value, the ratios are determined by subtracting amplifications times as will be appreciated by a person skilled in the art.

Accordingly, in this example the indicator values would be determined as follows:

$$In_1 = At(PLA2G7) - At(PLAC8)$$

$$In_2 = At(CEACAM4) - At(LAMP1)$$

At step 2525 the processing system 201 determines an indicator value by combining the ratios for the indicator values, as follows:

$$In = In_1 + In_2$$

The processing system 201 then compares the indicator value to one or more respective indicator references at step 2530.

As previously described, the indicator references are derived for a reference population and are used to indicate the likelihood of a subject suffering from inSIRS or ipSIRS. To achieve this, the reference population is grouped based on a clinical assessment into groups having/not having the conditions or a measure of severity, risk or progression stage of the condition, with this then being used to assess threshold indicator values that can distinguish between the groups or provide a measure of severity, risk or progression stage.

The comparison is performed by comparing the indicator to an indicator distribution determined for each group in the reference population. In the current example, there are two reference groups, with one corresponding to individuals diagnosed with inSIRS and the other for individuals diagnosed with ipSIRS. In this instance, the results of the comparison can be used to determine a likelihood of the individual having ipSIRS as opposed to inSIRS. This can be achieved using a number of different methods, depending on the preferred implementation.

An example of a reference distribution is shown in FIG. 26, which shows the distribution of indicator values for a reference population containing both inSIRS and ipSIRS samples. The density (y axis) describes how common scores are in the reference population. In FIG. 26, the most common values for the inSIRS population are in the range 1 to 8, and for the ipSIRS population are mostly in the range 5 to 13. By way of example, let us assume that the calculated indicator value for a new sample is 4. A value of 4 in the inSIRS population has a high density at this value (A), while the ipSIRS population has a low density at this value (B), meaning that this sample is more likely to be inSIRS. Conversely, if a sample has an indicator score of 10, this value in the ipSIRS reference population has a high density (C), while the inSIRS population has a low density (D), meaning this it is more probable that this sample with an indicator value of 10 belongs to the ipSIRS population.

In practice this process can be performed by determining a basic probability based on score bands. For a given score band (i.e. 4-6), the proportion of individuals with SIRS or SEPSIS is calculated. For example, if 40% of the scores between 4 and 6 were SEPSIS, then if an subject has an indicator value between 4 and 6, they have a 40% probability of sepsis. Thus, for a given range within the reference distribution, the probability of belonging to one group or another (SIRS/SEPSIS) can simply be the proportion of that group within the range.

An alternative technique is a standard Bayes method. In this case, the technique uses a distribution of inSIRS scores, a distribution of ipSIRS scores and an indicator value for the subject. In this example, a standard score or equivalent is used to generate a probability of the indicator value belonging to the inSIRS distribution: pr(inSIRS) and separately to the ipSIRS distribution: pr(ipSIRS). The Bayes method is used to generate the probability of ipSIRS given the individual distributions.

Thus, given derived biomarker distributions for two or more groups (i.e. inSIRS/ipSIRS), the probability of membership for a single unknown sample into each distribution can be calculated (p-value) using for example a standard score (z-score). Then the p-values for each distribution can be combined into an overall probability for each class (i.e. inSIRS/ipSIRS) using for example Bayes rule or any other probability calculation method (including frequentist or empirical or machine learned methods).

Thus, once the indicator value has been derived and compared to the indicator distributions, the results of this comparison are used by the processing system 201 to calculate a likelihood of the subject having ipSIRS at step 2535, with this being used to generate a representation of the results at step 2540, which is provided for display at step 2545, for example to a clinician or medical practitioner. This can be achieved by displaying the representation on a client device, such as part of an email, dashboard indication or the like.

Figure 27A:
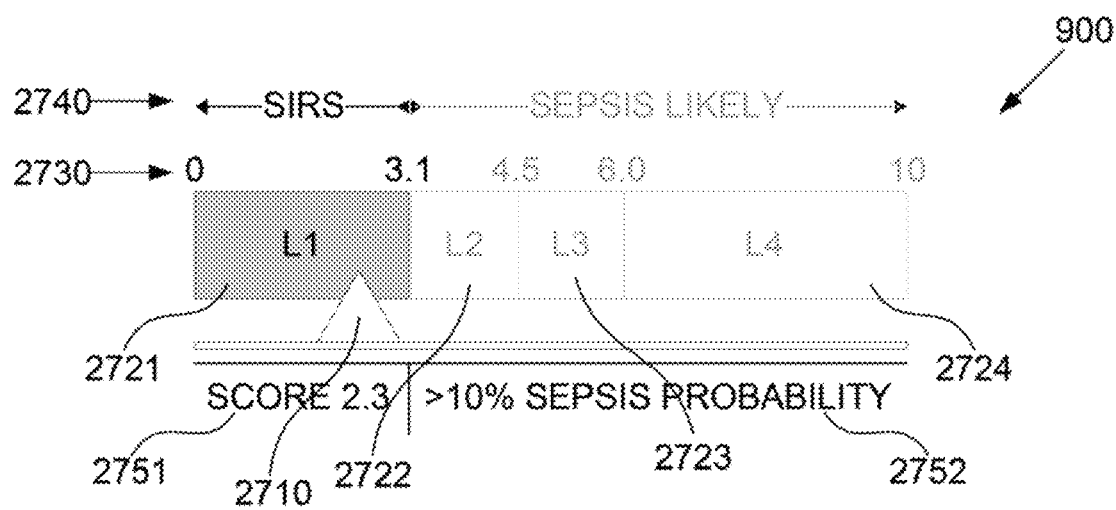
Figure 27B:
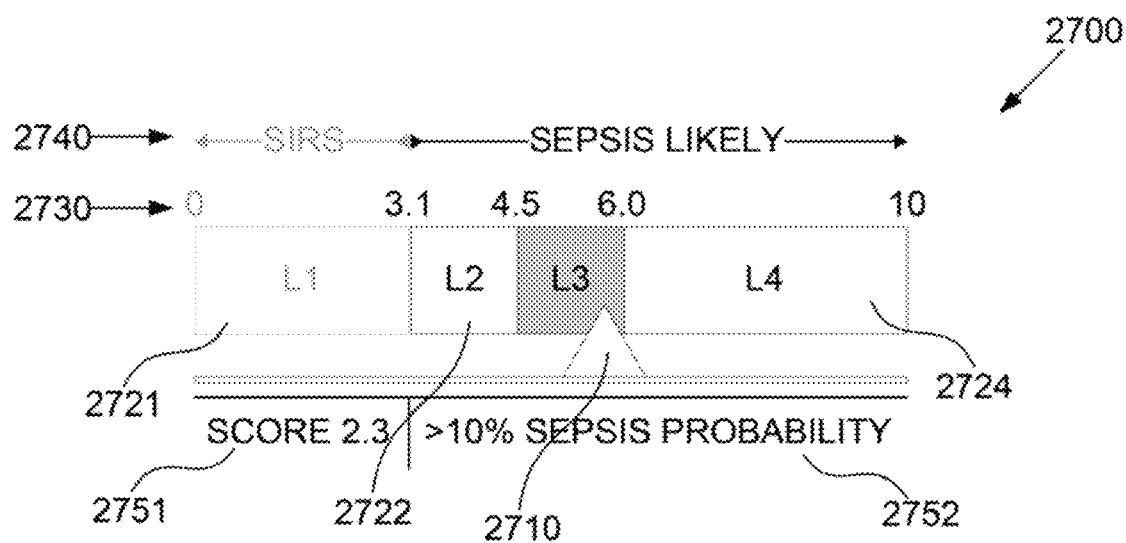

An example of the representation is shown in FIGS. 27A and 27B.

In this example, the representation 2700 includes a pointer 2710 that moves relative to a linear scale 2720. The linear scale is divided into regions 2721, 2722, 2723, 2724 which indicate whether the subject is suffering from level 1, 2, 3 or 4. Corresponding indicator number values are displayed at step 2730 with an indication of whether the corresponding value represents a likelihood of SIRS (inSIRS) or SEPSIS (ipSIRS) being shown at step 2740. An alphanumeric indication of the score is shown at step 2751 together with an associated probability of the biological subject having SEPSIS at step 2752.

As shown in this example, regions of the linear scale where the pointer is situated are highlighted with the diagnosis that is most unlikely being greyed out to make it absolutely clear where the subject sits on the scale. This results in a representation which when displayed at step 2545 is easy for a clinician to readily understand and to make a rapid diagnosis.

It will be appreciated from the above that a method can be provided for use in assessing the likelihood of a biological subject having inSIRS or ipSIRS the method including, in one or more processing devices:
  a) determining a pair of biomarker values, the pair of biomarker values being selected from the group consisting of:
    i) a first pair of biomarker values indicative of a concentration of polynucleotide expression products of the PLA2G7 gene and PLAC8 gene;
    ii) a second pair of biomarker values indicative of a concentration of polynucleotide expression products of the CEACAM4 gene and LAMP1 gene;
  b) determining an indicator indicative of a ratio of the concentrations of the polynucleotide expression products using the pair of biomarker values;
  c) retrieving previously determined first and second indicator references from a database, the first and second indicator references being determined based on indicators determined from first and second groups of a reference population, one of the groups consisting of individuals diagnosed with the medical condition;
  d) comparing the indicator to the first and second indicator references;
  e) using the results of the comparison to determine a probability indicative of the subject having the medical condition; and,
  f) generating a representation of the probability, the representation being displayed to a user to allow the user to assess the likelihood of a biological subject having at least one medical condition.

Similarly apparatus can be provided for determining the likelihood of a biological subject having inSIRS or ipSIRS, the apparatus including:
  a) a sampling device that obtains a sample taken from a biological subject, the sample including polynucleotide expression products;
  b) a measuring device that quantifies polynucleotide expression products within the sample to determine a pair of biomarker values, the pair of biomarker values being selected from the group consisting of:
    i) a first pair of biomarker values indicative of a concentration of polynucleotide expression products of the PLA2G7 gene and PLAC8 gene;
    ii) a second pair of biomarker values indicative of a concentration of polynucleotide expression products of the CEACAM4 gene and LAMP1 gene;
  c) at least one processing device that:
    i) receives an indication of the pair of biomarker values from the measuring device;
    ii) determines an indicator using a ratio of the concentration of the first and second polynucleotide expression products using the biomarker values; and,
    iii) compares the indicator to at least one indicator reference; and,
    iv) determines a likelihood of the subject having the at least one medical condition using the results of the comparison; and,
    v) generates a representation of the indicator and the likelihood for display to a user.

A further method that can be provided includes differentiating between inSIRS and ipSIRS in a biological subject, the method including:
  a) obtaining a sample taken from a biological subject showing a clinical sign of SIRS, the sample including polynucleotide expression products;
  b) in a measuring device:
    i) amplifying at least some polynucleotide expression products in the sample;
    ii) determining an amplification amount representing a degree of amplification required to obtain a defined level of polynucleotide expression products including:
      (1) amplification amounts for a first pair of polynucleotide expression products of the PLA2G7 gene and PLAC8 gene;
      (2) amplification amounts for a second pair of polynucleotide expression products of the CEACAM4 gene and LAMP1 gene;
  c) in a processing system:
    i) retrieving the amplification amounts;
    ii) determining an indicator by:
      (1) determining a first derived biomarker value indicative of a ratio of concentrations of the first pair of polynucleotide expression products by determining a difference between the amplification amounts for the first pair;
      (2) determining a second derived biomarker value indicative of a ratio of concentrations of the second pair of polynucleotide expression products by determining a difference between the amplification amounts for the second pair;
      (3) determining the indicator by adding the first and second derived biomarker values;
    iii) retrieving previously determined first and second indicator references from a database, wherein the first and second indicator references are distributions of indicators determined for first and second groups of a reference population, the first and second group consisting of individuals diagnosed with inSIRS and ipSIRS respectively;
    iv) comparing the indicator to the first and second indicator references;
    v) using the results of the comparison to determine a probability of the subject being classified within the first or second group;
    vi) generating a representation at least partially indicative of the indicator and the probability; and,
    vii) providing the representation to a user to allow the user to assess the likelihood of a biological subject having at least one medical condition.

Additionally, a method can be provided for determining an indicator used in assessing a likelihood of a biological subject having a presence, absence, degree or prognosis of at least one medical condition, the method including:
  a) determining a plurality of biomarker values, each biomarker value being indicative of a value measured or derived for at least one corresponding immune system biomarker of the biological subject and being at least partially indicative of a concentration of the immune system biomarker in a sample taken from the subject;
  b) determining the indicator using a combination of the plurality of biomarker values, wherein:
    i) at least two biomarkers have a mutual correlation in respect of the at least one condition that lies within a mutual correlation range, the mutual correlation range being between ±0.9; and,
    ii) the indicator has a performance value greater than or equal to a performance threshold representing the ability of the indicator to diagnose the presence, absence, degree or prognosis of the at least one condition, the performance threshold being indicative of an explained variance of at least 0.3.

Throughout this specification and claims which follow, unless the context requires otherwise, the word "comprise", and variations such as "comprises" or "comprising", will be understood to imply the inclusion of a stated integer or group of integers or steps but not the exclusion of any other integer or group of integers.

Persons skilled in the art will appreciate that numerous variations and modifications will become apparent. All such variations and modifications which become apparent to persons skilled in the art, should be considered to fall within the spirit and scope that the invention broadly appearing before described.

TABLE 1

| HGNC§ Gene Name | SEQ ID NO |
|---|---|
| PRKCZ | 1 |
| SKI | 2 |
| RER1 | 3 |
| TAS1R1 | 4 |
| VAMP3 | 5 |
| AGTRAP | 6 |
| VPS13D | 7 |
| KLHDC7A | 8 |
| NBL1//C1orf151 | 9 |
| MDS2 | 10 |
| RCAN3 | 11 |
| LDLRAP1 | 12 |
| MAN1C1 | 13 |
| SH3BGRL3 | 14 |
| DHDDS | 15 |
| HCRTR1 | 16 |
| CCDC28B | 17 |
| LCK | 18 |
| ZNF362 | 19 |
| THRAP3 | 20 |
| PPIE//CCDC25 | 21 |
| CAP1 | 22 |
| CTPS | 23 |
| C1orf84 | 24 |
| FAAH | 25 |
| DMBX1 | 26 |
| CYP4B1 | 27 |
| BTF3L4 | 28 |
| LRRC42 | 29 |
| C1orf175//TTC4 | 30 |
| TMEM61 | 31 |
| FPGT//TNNI3K | 32 |
| ACADM | 33 |
| SPATA1 | 34 |
| EPHX4 | 35 |
| RPAP2 | 36 |
| RPL5//SNORA66//SNORD21//FAM69A | 37 |
| RTCD1 | 38 |
| SLC30A7 | 39 |
| RNPC3//AMY2B | 40 |
| CELSR2 | 41 |
| AHCYL1 | 42 |
| CEPT1//DRAM2 | 43 |
| CHIA | 44 |
| LIX1L | 45 |
| UPF0627 | 46 |
| MRPS21 | 47 |
| TNFAIP8L2 | 48 |
| SMCP | 49 |
| DCST1 | 50 |
| RAG1AP1 | 51 |
| C1orf182 | 52 |
| HAPLN2 | 53 |
| NTRK1 | 54 |
| CD1E | 55 |

TABLE 1-continued

| HGNC§ Gene Name | SEQ ID NO |
|---|---|
| TOMM40L//NR1I3 | 56 |
| POU2F1 | 57 |
| TIPRL | 58 |
| SFT2D2 | 59 |
| CACNA1E | 60 |
| SMG7 | 61 |
| OCLM | 62 |
| RGS2 | 63 |
| ZC3H11A//RP11-74E24.2 | 64 |
| MFSD4 | 65 |
| IL20 | 66 |
| RPS6KC1 | 67 |
| C1orf95 | 68 |
| ARF1 | 69 |
| GALNT2 | 70 |
| TNFRSF4 | 71 |
| NADK | 72 |
| FLJ14100//C1orf86 | 73 |
| GPR153 | 74 |
| RERE | 75 |
| SLC2A7 | 76 |
| SDHB | 77 |
| RNF186 | 78 |
| DDOST | 79 |
| GPN2 | 80 |
| RPA2 | 81 |
| PEF1 | 82 |
| PTP4A2 | 83 |
| TRIM62 | 84 |
| PHC2 | 85 |
| LSM10 | 86 |
| MRPS15 | 87 |
| RRAGC | 88 |
| COL9A2 | 89 |
| TESK2 | 90 |
| NRD1 | 91 |
| KTI12 | 92 |
| CC2D1B | 93 |
| YIPF1 | 94 |
| JAK1 | 95 |
| SLC35D1 | 96 |
| DIRAS3 | 97 |
| ZZZ3 | 98 |
| GNG5 | 99 |
| ZNHIT6 | 100 |
| ODF2L | 101 |
| SEP15 | 102 |
| BARHL2 | 103 |
| GCLM | 104 |
| CLCC1//GPSM2//C1orf62 | 105 |
| SORT1 | 106 |
| SLC16A4 | 107 |
| PHTF1 | 108 |
| RSBN1 | 109 |
| DENND2C//BCAS2 | 110 |
| CD58 | 111 |
| SPAG17//WDR3 | 112 |
| REG4//NBPF7 | 113 |
| RP11-94I2.2//NBPF16//NBPF11//NBPF15//NBPF8//NBPF20//NBPF10//NBPF14//NBPF1//LOC100288142//NBPF12//KIAA1245//LOC100290137 | 114 |
| APH1A | 115 |
| POGZ | 116 |
| TDRKH | 117 |
| THEM4 | 118 |
| S100A11 | 119 |
| CRNN | 120 |
| SPRR2C | 121 |
| S100A12 | 122 |
| S100A8 | 123 |
| GATAD2B//PLIN2 | 124 |

TABLE 1-continued

| HGNC§ Gene Name | SEQ ID NO |
|---|---|
| DENND4B | 125 |
| PBXIP1 | 126 |
| PYGO2 | 127 |
| SHC1 | 128 |
| DCST2 | 129 |
| GBA//GBAP | 130 |
| ASH1L | 131 |
| RIT1 | 132 |
| MEF2D | 133 |
| AIM2 | 134 |
| COPA | 135 |
| DEDD | 136 |
| TADA1L | 137 |
| GPA33 | 138 |
| CD247 | 139 |
| F5 | 140 |
| PIGC | 141 |
| KIAA0040 | 142 |
| TOR1AIP2//TOR1AIP1//IFRG15 | 143 |
| STX6//KIAA1614 | 144 |
| EDEM3 | 145 |
| UCHL5 | 146 |
| DENND1B | 147 |
| DDX59 | 148 |
| KIF21B | 149 |
| ARL8A | 150 |
| CYB5R1 | 151 |
| MYBPH | 152 |
| CHI3L1 | 153 |
| PIK3C2B//LOC100130573 | 154 |
| NUAK2 | 155 |
| NUCKS1 | 156 |
| FAIM3 | 157 |
| PLXNA2 | 158 |
| SLC30A1 | 159 |
| LPGAT1 | 160 |
| ANGEL2 | 161 |
| RAB3GAP2//AURKAPS1//AURKA//SNORA36B | 162 |
| TP53BP2 | 163 |
| NVL | 164 |
| TMEM63A | 165 |
| PARP1 | 166 |
| ITPKB | 167 |
| TARBP1 | 168 |
| CHML | 169 |
| AKT3 | 170 |
| SMYD3 | 171 |
| AHCTF1 | 172 |
| OR1C1 | 173 |
| NCOA1 | 174 |
| HADHB | 175 |
| ABHD1//PREB | 176 |
| SPAST | 177 |
| SLC30A6//DDX50 | 178 |
| CRIPT | 179 |
| MSH2 | 180 |
| FOXN2 | 181 |
| CCDC104 | 182 |
| VRK2 | 183 |
| AHSA2//USP34 | 184 |
| OTX1 | 185 |
| AFTPH | 186 |
| CEP68 | 187 |
| PLEK | 188 |
| ANXA4 | 189 |
| MXD1 | 190 |
| NAGK | 191 |
| SMYD5//NOTO | 192 |
| MTHFD2 | 193 |
| TTC31 | 194 |
| SEMA4F | 195 |
| TMSB10 | 196 |
| SH2D6 | 197 |
| GNLY | 198 |
| KCNIP3 | 199 |
| CNNM4 | 200 |
| CNNM3 | 201 |
| ZAP70 | 202 |
| LIPT1//MRPL30 | 203 |
| MAP4K4 | 204 |
| IL1R2 | 205 |
| IL1R1 | 206 |
| IL18R1 | 207 |
| POLR1B | 208 |
| CHCHD5 | 209 |
| IL1RN | 210 |
| PSD4 | 211 |
| DDX18 | 212 |
| INSIG2 | 213 |
| TMEM177//LOC100125918 | 214 |
| RALB | 215 |
| PROC | 216 |
| GPR17//LOC100291428//LIMS2 | 217 |
| IMP4 | 218 |
| FAM123C | 219 |
| ACVR2A | 220 |
| MBD5 | 221 |
| LYPD6B | 222 |
| SLC4A10 | 223 |
| UBR3 | 224 |
| HAT1 | 225 |
| ITGA6 | 226 |
| ZAK | 227 |
| OSBPL6 | 228 |
| PLEKHA3 | 229 |
| ZC3H15 | 230 |
| COL3A1 | 231 |
| GLS | 232 |
| OBFC2A | 233 |
| COQ10B | 234 |
| MARS2 | 235 |
| CFLAR | 236 |
| NOP58 | 237 |
| FAM117B | 238 |
| CYP20A1 | 239 |
| FASTKD2 | 240 |
| PIKFYVE | 241 |
| C2orf62 | 242 |
| SLC11A1 | 243 |
| AGFG1 | 244 |
| CHRNG | 245 |
| EIF4E2 | 246 |
| TRPM8 | 247 |
| LRRFIP1 | 248 |
| GAL3ST2 | 249 |
| TMEM18 | 250 |
| LAPTM4A | 251 |
| SF3B14 | 252 |
| TP53I3 | 253 |
| UNQ2999 | 254 |
| GPR113//SELI | 255 |
| MPV17 | 256 |
| PPM1G | 257 |
| NLRC4 | 258 |
| CDC42EP3 | 259 |
| HNRPLL | 260 |
| COX7A2L | 261 |
| KCNG3 | 262 |
| CALM2//C2orf61 | 263 |
| BCL11A | 264 |
| XPO1 | 265 |
| NAT8B | 266 |
| DUSP11 | 267 |
| MOGS | 268 |
| SNRNP200 | 269 |
| SEMA4C | 270 |
| MITD1 | 271 |
| IL1A | 272 |
| SLC35F5 | 273 |
| CCDC93 | 274 |
| CLASP1 | 275 |

TABLE 1-continued

| HGNC§ Gene Name | SEQ ID NO |
|---|---|
| SAP130 | 276 |
| YSK4 | 277 |
| GTDC1 | 278 |
| ORC4L | 279 |
| NR4A2//FLJ46875 | 280 |
| DPP4 | 281 |
| GALNT3 | 282 |
| SCN7A | 283 |
| FRZB | 284 |
| STK17B | 285 |
| CLK1//PPIL3 | 286 |
| MPP4 | 287 |
| INO80D | 288 |
| KLF7 | 289 |
| FAM119A | 290 |
| NGEF | 291 |
| ARL4C | 292 |
| RAB17 | 293 |
| HDLBP | 294 |
| LRRN1 | 295 |
| SETD5 | 296 |
| IRAK2 | 297 |
| C3orf42 | 298 |
| TSEN2 | 299 |
| NR2C2//MRPS25 | 300 |
| UBE2E1 | 301 |
| C3orf35 | 302 |
| SNRK | 303 |
| ZNF197 | 304 |
| GNAI2 | 305 |
| ALAS1 | 306 |
| PRKCD | 307 |
| CACNA1D | 308 |
| PXK | 309 |
| PTPRG | 310 |
| ATXN7 | 311 |
| SLC35A5 | 312 |
| SLC15A2 | 313 |
| CCDC48 | 314 |
| DNAJC13 | 315 |
| CLDN18 | 316 |
| GYG1 | 317 |
| SELT | 318 |
| MED12L | 319 |
| RAP2B | 320 |
| MYNN | 321 |
| ABCF3 | 322 |
| VPS8 | 323 |
| HRG | 324 |
| EIF4A2//SNORA4 | 325 |
| LPP | 326 |
| CCDC50 | 327 |
| LOC152217 | 328 |
| TADA3L | 329 |
| SEC13 | 330 |
| TIMP4 | 331 |
| METTL6 | 332 |
| DAZL//DAZ4//DAZ3//DAZ2 | 333 |
| SATB1//TBC1D5 | 334 |
| SCN10A | 335 |
| SEC22C | 336 |
| ZDHHC3a | 337 |
| ZDHHC3b | 338 |
| SLC6A20 | 339 |
| UQCRC1 | 340 |
| PRKAR2A | 341 |
| IMPDH2 | 342 |
| CCDC71 | 343 |
| UBA7 | 344 |
| CAMKV | 345 |
| WDR82 | 346 |
| LMOD3 | 347 |
| FOXP1 | 348 |
| MORC1 | 349 |
| ATG3 | 350 |
| GSK3B//LOC100129275 | 351 |
| HCLS1 | 352 |
| KPNA1 | 353 |
| PTPLB | 354 |
| C3orf22 | 355 |
| RPN1 | 356 |
| KIAA1257//ACAD9//LOC100132731 | 357 |
| FOXL2 | 358 |
| MECOM | 359 |
| PLD1 | 360 |
| GNB4 | 361 |
| MRPL47 | 362 |
| KLHL6 | 363 |
| THPO | 364 |
| ETV5 | 365 |
| BCL6//LOC100131635 | 366 |
| ATP13A5 | 367 |
| TMEM44 | 368 |
| KIAA1530 | 369 |
| TACC3 | 370 |
| CNO | 371 |
| BST1 | 372 |
| KLF3 | 373 |
| TMEM33//DCAF4L1 | 374 |
| KIT | 375 |
| ENAM | 376 |
| FAM47E//STBD1 | 377 |
| ENOPH1 | 378 |
| PDLIM5 | 379 |
| CCDC109B//HIGD1A//CCDC13 | 380 |
| EGF | 381 |
| PCDH10 | 382 |
| RAB33B | 383 |
| TMEM184C | 384 |
| RBM46 | 385 |
| GRIA2 | 386 |
| C4orf39 | 387 |
| KLHL2 | 388 |
| TLL1 | 389 |
| F11 | 390 |
| SLBP | 391 |
| HAUS3//POLN | 392 |
| PPARGC1A | 393 |
| TLR10 | 394 |
| C4orf34 | 395 |
| TXK | 396 |
| RPL21P44 | 397 |
| KDR | 398 |
| RCHY1 | 399 |
| CNOT6L | 400 |
| PLAC8 | 401 |
| HPSE | 402 |
| GPRIN3 | 403 |
| PPA2 | 404 |
| COL25A1 | 405 |
| C4orf3 | 406 |
| QRFPR | 407 |
| MFSD8 | 408 |
| MAP9 | 409 |
| PDGFC | 410 |
| TKTL2 | 411 |
| ACSL1 | 412 |
| SUB1//TMEM183A | 413 |
| CARD6 | 414 |
| MCCC2 | 415 |
| TNPO1 | 416 |
| PDE8B | 417 |
| PAPD4 | 418 |
| THBS4 | 419 |
| FAM151B | 420 |
| RASGRF2 | 421 |
| SNX2 | 422 |
| LMNB1//PCIF1 | 423 |
| MEGF10 | 424 |
| LEAP2 | 425 |
| TCF7 | 426 |

TABLE 1-continued

| HGNC§ Gene Name | SEQ ID NO |
|---|---|
| KDM3B | 427 |
| CXXC5 | 428 |
| SLC4A9 | 429 |
| ANKHD1-EIF4EBP3//ANKHD1//EIF4EBP3 | 430 |
| KIAA0141 | 431 |
| GRPEL2 | 432 |
| MFAP3 | 433 |
| GABRA6 | 434 |
| GABRA1 | 435 |
| DOCK2 | 436 |
| RANBP17//USP12 | 437 |
| ERGIC1 | 438 |
| ATP6V0E1//SNORA74B | 439 |
| ZNF346 | 440 |
| NSD1 | 441 |
| CLPTM1L | 442 |
| UGT3A1 | 443 |
| GDNF | 444 |
| TTC33 | 445 |
| hCG_2039148 | 446 |
| MOCS2 | 447 |
| SLC38A9 | 448 |
| CCDC125 | 449 |
| ANKRA2 | 450 |
| HAPLN1 | 451 |
| CCNH | 452 |
| TMEM161B | 453 |
| MBLAC2 | 454 |
| MCTP1 | 455 |
| TICAM2//TMED7//TMED7-TICAM2 | 456 |
| KIF3A | 457 |
| C5orf15 | 458 |
| SKP1 | 459 |
| CXCL14 | 460 |
| KLHL3 | 461 |
| CD14 | 462 |
| YIPF5 | 463 |
| LARS | 464 |
| DCTN4 | 465 |
| CCDC69 | 466 |
| ATOX1 | 467 |
| TIMD4 | 468 |
| ADAM19 | 469 |
| SLIT3 | 470 |
| RNF44 | 471 |
| DOK3 | 472 |
| MGAT4B//SQSTM1 | 473 |
| C5orf45//SQSTM1 | 474 |
| RASGEF1C | 475 |
| MGAT1 | 476 |
| IRF4 | 477 |
| HIVEP1 | 478 |
| E2F3 | 479 |
| HIST1H4I | 480 |
| HIST1H2BM | 481 |
| MOG | 482 |
| ZNRD1//NCRNA00171 | 483 |
| TRIM15 | 484 |
| HCG27 | 485 |
| BAT2//SNORA38 | 486 |
| CYP21A2 | 487 |
| ITPR3 | 488 |
| MAPK14 | 489 |
| MAPK13 | 490 |
| PNPLA1 | 491 |
| SFRS3 | 492 |
| CDKN1A | 493 |
| FOXP4 | 494 |
| CUL9 | 495 |
| RUNX2 | 496 |
| ZNF451 | 497 |
| SOBP | 498 |
| C6orf182 | 499 |
| KIAA1919 | 500 |
| RWDD1 | 501 |
| KPNA5 | 502 |
| TPD52L1 | 503 |
| ARG1 | 504 |
| RAB32 | 505 |
| ARID1B | 506 |
| SLC22A3 | 507 |
| SERPINB1 | 508 |
| C6orf146 | 509 |
| GCM2 | 510 |
| ATXN1 | 511 |
| DCDC2//KAAG1 | 512 |
| HIST1H3I | 513 |
| HIST1H4L | 514 |
| GABBR1 | 515 |
| RNA243 | 516 |
| DDAH2 | 517 |
| CLIC1 | 518 |
| NEU1 | 519 |
| RXRB | 520 |
| VPS52 | 521 |
| TCP11 | 522 |
| CLPS | 523 |
| PGC | 524 |
| ZNF318 | 525 |
| YIPF3 | 526 |
| MRPL14 | 527 |
| PLA2G7 | 528 |
| PKHD1 | 529 |
| IL17F | 530 |
| HTR1B | 531 |
| GABRR2 | 532 |
| UBE2J1 | 533 |
| BACH2 | 534 |
| MCM9 | 535 |
| VNN1 | 536 |
| IL20RA | 537 |
| FLJ27255 | 538 |
| T | 539 |
| RPS6KA2 | 540 |
| HGC6.3 | 541 |
| UNC84A//C7orf20 | 542 |
| SDK1 | 543 |
| ZDHHC4 | 544 |
| C7orf26 | 545 |
| GLCCI1//tcag7.903 | 546 |
| GPNMB | 547 |
| CCDC126 | 548 |
| WIPF3//ZNRF2//LOC441208 | 549 |
| GPR141 | 550 |
| STARD3NL | 551 |
| POU6F2 | 552 |
| CDC2L5 | 553 |
| ZMIZ2 | 554 |
| UPP1 | 555 |
| ZNF273 | 556 |
| KCTD7//RABGEF1 | 557 |
| RABGEF1//tcag7.967//tcag7.951//KCTD7//LOC100293333 | 558 |
| CCDC132 | 559 |
| PVRIG//PILRB//STAG3 | 560 |
| PILRB//PVRIG//STAG3 | 561 |
| C7orf51 | 562 |
| GNB2 | 563 |
| LRRC17 | 564 |
| LRRN3 | 565 |
| CFTR | 566 |
| LSM8 | 567 |
| LUC7L2 | 568 |
| MGAM//LOC100124692 | 569 |
| GIMAP7 | 570 |
| INSIG1 | 571 |
| RBM33 | 572 |
| ICA1 | 573 |
| FAM126A | 574 |
| HIBADH | 575 |

TABLE 1-continued

| HGNC§ Gene Name | SEQ ID NO |
|---|---|
| TRIL | 576 |
| SCRN1 | 577 |
| ELMO1 | 578 |
| INHBA | 579 |
| CAMK2B | 580 |
| NPC1L1 | 581 |
| DDC//LOC100129427 | 582 |
| NSUN5//NSUN5B//NSUN5C | 583 |
| CLDN3 | 584 |
| C7orf23//DMTF1 | 585 |
| SRI | 586 |
| BET1 | 587 |
| MCM7 | 588 |
| GATS | 589 |
| ATXN7L1//RINT1//EFCAB10 | 590 |
| KIAA1549 | 591 |
| SLC37A3 | 592 |
| SMARCD3 | 593 |
| MLL3//BAGE2 | 594 |
| CLN8 | 595 |
| MSRA | 596 |
| PIWIL2 | 597 |
| NEFM//LOC100129717 | 598 |
| EPHX2 | 599 |
| LEPROTL1 | 600 |
| MAK16//C8orf41 | 601 |
| AP3M2 | 602 |
| FNTA | 603 |
| SGK196 | 604 |
| UBE2V2 | 605 |
| FLJ46365 | 606 |
| SNTG1 | 607 |
| TRIM55 | 608 |
| C8orf45 | 609 |
| PREX2 | 610 |
| PLEKHF2 | 611 |
| BAALC//FLJ10489 | 612 |
| TTC35 | 613 |
| MTBP | 614 |
| ZHX2 | 615 |
| RNF139 | 616 |
| TG | 617 |
| DENND3//C8orf60 | 618 |
| TNFRSF10D | 619 |
| TRIM35 | 620 |
| GSR | 621 |
| WHSC1L1 | 622 |
| PCMTD1//PXDNL | 623 |
| NCOA2 | 624 |
| TRAM1//LOC286190 | 625 |
| RUNX1T1 | 626 |
| EXT1 | 627 |
| DDEF1IT1 | 628 |
| CDC37L1 | 629 |
| UBE2R2 | 630 |
| UBAP1//KIF24 | 631 |
| GALT | 632 |
| RGP1//GBA2 | 633 |
| TGFBR1 | 634 |
| C9orf6//IKBKAP | 635 |
| IMAGE5303689 | 636 |
| ATP6V1G1 | 637 |
| TLR4 | 638 |
| SET | 639 |
| MRPL41 | 640 |
| C9orf68 | 641 |
| HAUS6//SCARNA8 | 642 |
| KLHL9 | 643 |
| C9orf82 | 644 |
| NDUFB6//DFFB | 645 |
| SIT1 | 646 |
| FAM108B1 | 647 |
| TRPM6 | 648 |
| FRMD3 | 649 |
| SLC28A3 | 650 |

TABLE 1-continued

| HGNC§ Gene Name | SEQ ID NO |
|---|---|
| BICD2 | 651 |
| C9orf84 | 652 |
| AKNA | 653 |
| MEGF9 | 654 |
| C5 | 655 |
| GOLGA1//SCAI | 656 |
| SH2D3C | 657 |
| FAM102A | 658 |
| FLJ10232 | 659 |
| ASB6 | 660 |
| BAT2L | 661 |
| EDF1 | 662 |
| FBXW5 | 663 |
| C10orf18 | 664 |
| FBXO18 | 665 |
| GATA3 | 666 |
| CUGBP2 | 667 |
| VIM | 668 |
| STAM | 669 |
| WAC | 670 |
| BAMBI | 671 |
| ZNF487//LOC439911 | 672 |
| ALOX5 | 673 |
| WDFY4 | 674 |
| SRGN | 675 |
| CCDC109A | 676 |
| FAM149B1//FAM149B2 | 677 |
| MINPP1 | 678 |
| PTEN//PTENP1 | 679 |
| ENTPD1//C10orf131 | 680 |
| ABCC2 | 681 |
| SFXN2 | 682 |
| SHOC2 | 683 |
| ACSL5 | 684 |
| BCCIP//DHX32 | 685 |
| FAM188A | 686 |
| CUBN | 687 |
| SVIL//hCG_1783494 | 688 |
| FAM13C//PHYHIPL | 689 |
| ATAD1 | 690 |
| ANKRD22 | 691 |
| FLJ34077 | 692 |
| COX15 | 693 |
| ERLIN1 | 694 |
| ACTR1A | 695 |
| ABLIM1 | 696 |
| RAB11FIP2 | 697 |
| C10orf84 | 698 |
| PRDX3 | 699 |
| C10orf119 | 700 |
| NSMCE4A | 701 |
| TALDO1//INTS8 | 702 |
| TNNT3 | 703 |
| FXC1 | 704 |
| PDE3B | 705 |
| DNAJC24 | 706 |
| PTPRJ//OR4B1 | 707 |
| C11orf31 | 708 |
| TMEM109 | 709 |
| CD6 | 710 |
| CD5 | 711 |
| TMEM138 | 712 |
| POLR2G | 713 |
| TMEM179B | 714 |
| NAT11 | 715 |
| OTUB1 | 716 |
| RBM14//RBM4 | 717 |
| AIP | 718 |
| PPFIA1 | 719 |
| IL18BP//NUMA1 | 720 |
| C11orf30 | 721 |
| C11orf82 | 722 |
| TMEM126B | 723 |
| C11orf73 | 724 |
| PIWIL4 | 725 |
| LOC100132686 | 726 |
| PAFAH1B2 | 727 |

TABLE 1-continued

| HGNC§ Gene Name | SEQ ID NO |
|---|---|
| UBE4A | 728 |
| TRAPPC4 | 729 |
| SC5DL | 730 |
| VWA5A//OR10D1P | 731 |
| STT3A | 732 |
| VPS26B | 733 |
| TRIM21 | 734 |
| ZBED5 | 735 |
| SAAL1 | 736 |
| FANCF | 737 |
| LIN7C | 738 |
| PHF21A | 739 |
| CUGBP1 | 740 |
| OSBP | 741 |
| CYBASC3 | 742 |
| TUT1 | 743 |
| SLC25A45 | 744 |
| LTBP3 | 745 |
| EIF1AD | 746 |
| GAB2 | 747 |
| CREBZF | 748 |
| PICALM | 749 |
| SLC36A4 | 750 |
| CCDC82 | 751 |
| KIAA1826 | 752 |
| MPZL3 | 753 |
| MPZL2 | 754 |
| H2AFX | 755 |
| SIAE | 756 |
| ZBTB44 | 757 |
| HSN2 | 758 |
| ADIPOR2 | 759 |
| NCAPD2//SCARNA10//FADS1 | 760 |
| PTPN6 | 761 |
| CLEC4D | 762 |
| CDKN1B | 763 |
| GOLT1B | 764 |
| FAR2 | 765 |
| FGD4 | 766 |
| TMEM106C | 767 |
| TMBIM6 | 768 |
| C12orf62 | 769 |
| PRR13//PCBP2 | 770 |
| DGKA | 771 |
| COQ10A | 772 |
| TSPAN31 | 773 |
| CDK4/MARCH9/C3HC4 | 774 |
| LEMD3 | 775 |
| IRAK3 | 776 |
| TMTC3 | 777 |
| ACTR6 | 778 |
| TCTN1 | 779 |
| PXMP2//PGAM5 | 780 |
| DCP1B | 781 |
| SLC2A3//SLC2A14 | 782 |
| C3AR1 | 783 |
| PLBD1 | 784 |
| TM7SF3 | 785 |
| ASB8//PHB | 786 |
| LMBR1L | 787 |
| FMNL3//PRPF40B | 788 |
| AAAS | 789 |
| NFE2 | 790 |
| GPR84 | 791 |
| CD63 | 792 |
| SARNP//DNAJC14 | 793 |
| NACA | 794 |
| CDK4//TSPAN31 | 795 |
| TMBIM4//LOC100133322 | 796 |
| IL22 | 797 |
| LIN7A | 798 |
| HAL | 799 |
| APPL2 | 800 |
| GLTP | 801 |
| GIT2 | 802 |
| VPS29 | 803 |
| PPTC7 | 804 |
| DDX54//CCDC42B | 805 |
| SLC24A6 | 806 |
| SDS | 807 |
| RBM19 | 808 |
| MED13L | 809 |
| C12orf49 | 810 |
| FBXO21 | 811 |
| WSB2 | 812 |
| TAOK3 | 813 |
| CIT | 814 |
| RAB35 | 815 |
| RPLP0 | 816 |
| PXN | 817 |
| TRIAP1 | 818 |
| SFRS9 | 819 |
| POP5 | 820 |
| UNQ1887 | 821 |
| C12orf43 | 822 |
| ANAPC5 | 823 |
| KDM2B | 824 |
| MORN3 | 825 |
| TMEM120B//RHOF | 826 |
| LOC338799 | 827 |
| DIABLO//B3GNT4 | 828 |
| VPS33A | 829 |
| CLIP1 | 830 |
| PITPNM2 | 831 |
| EIF2B1 | 832 |
| CCDC92 | 833 |
| NCOR2 | 834 |
| DHX37 | 835 |
| DDX51 | 836 |
| POLE | 837 |
| GOLGA3 | 838 |
| ZMYM2 | 839 |
| SPATA13//C1QTNF9 | 840 |
| NUPL1 | 841 |
| PAN3//EEF1A1//CHCHD2 | 842 |
| ALOX5AP | 843 |
| EEF1DP3 | 844 |
| KL | 845 |
| UFM1 | 846 |
| NARG1L | 847 |
| ITM2B | 848 |
| FNDC3A | 849 |
| CDADC1 | 850 |
| ARL11 | 851 |
| LMO7 | 852 |
| DNAJC3 | 853 |
| TM9SF2 | 854 |
| CLYBL | 855 |
| PCCA | 856 |
| ABHD13 | 857 |
| LAMP1 | 858 |
| TMCO3 | 859 |
| UPF3A | 860 |
| ZMYM5//ZMYM2 | 861 |
| ZDHHC20//LOC728099 | 862 |
| PARP4 | 863 |
| MTMR6//LOC646482 | 864 |
| HSPH1 | 865 |
| N4BP2L2//CG030 | 866 |
| ELF1 | 867 |
| LCP1 | 868 |
| KPNA3 | 869 |
| C13orf1 | 870 |
| DLEU2//DLEU2L | 871 |
| GUCY1B2 | 872 |
| INTS6 | 873 |
| DACH1 | 874 |
| TBC1D4 | 875 |
| EDNRB | 876 |
| UGGT2 | 877 |
| GPR183 | 878 |
| LIG4 | 879 |
| ANKRD10 | 880 |

TABLE 1-continued

| HGNC§ Gene Name | SEQ ID NO |
|---|---|
| RASA3 | 881 |
| RNASE2//LOC643332 | 882 |
| RPGRIP1 | 883 |
| IRF9 | 884 |
| TSSK4 | 885 |
| C14orf21 | 886 |
| SCFD1 | 887 |
| FANCM | 888 |
| ABHD12B | 889 |
| PTGDR | 890 |
| FBXO34//KIAA0831 | 891 |
| C14orf101 | 892 |
| ACTR10 | 893 |
| ARID4A | 894 |
| JKAMP | 895 |
| HIF1A | 896 |
| SYNE2 | 897 |
| EXD2 | 898 |
| SLC39A9 | 899 |
| SFRS5 | 900 |
| PCNX | 901 |
| SIPA1L1//SNORD56B//LOC145474//LOC283567 | 902 |
| YLPM1 | 903 |
| BATF | 904 |
| FLVCR2//RPS24 | 905 |
| GPR65 | 906 |
| TDP1 | 907 |
| EVL | 908 |
| ZNF839 | 909 |
| TDRD9 | 910 |
| INF2 | 911 |
| PLD4 | 912 |
| MTA1//LOC647310//LOC100128343 | 913 |
| NDRG2 | 914 |
| DAD1//OR6J1 | 915 |
| SLC7A8 | 916 |
| IPO4 | 917 |
| TM9SF1 | 918 |
| ADCY4 | 919 |
| RIPK3 | 920 |
| EAPP | 921 |
| BAZ1A | 922 |
| NFKBIA | 923 |
| SEC23A | 924 |
| C14orf104 | 925 |
| C14orf138 | 926 |
| SOS2 | 927 |
| NIN | 928 |
| PYGL | 929 |
| CNIH | 930 |
| DHRS7 | 931 |
| WDR89 | 932 |
| ACTN1 | 933 |
| NUMB | 934 |
| C14orf43 | 935 |
| ABCD4 | 936 |
| KIAA0317 | 937 |
| NEK9 | 938 |
| ANGEL1 | 939 |
| SPTLC2 | 940 |
| SERPINA6 | 941 |
| DICER1 | 942 |
| BCL11B | 943 |
| ANKRD9 | 944 |
| PPP1R13B | 945 |
| AKT1 | 946 |
| BRF1 | 947 |
| TUBGCP5 | 948 |
| SNRPN* | 949 |
| APBA2 | 950 |
| MTMR15//MTMR10 | 951 |
| RYR3 | 952 |
| BAHD1 | 953 |
| CHP | 954 |
| JMJD7- | 955 |
| PLA2G4B//JMJD7//PLA2G4B | |
| HAUS2 | 956 |
| C15orf63//SERF2 | 957 |
| B2M | 958 |
| TRIM69 | 959 |
| PLDN | 960 |
| SQRDL | 961 |
| GALK2 | 962 |
| USP8 | 963 |
| GLDN | 964 |
| MAPK6 | 965 |
| LACTB | 966 |
| RAB8B | 967 |
| APH1B | 968 |
| USP3//LOC100130855 | 969 |
| SNX1 | 970 |
| LBXCOR1//PIAS1//CALML4 | 971 |
| NEO1 | 972 |
| MPI | 973 |
| FBXO22//FBXO22OS | 974 |
| RCN2 | 975 |
| FAH | 976 |
| IL16 | 977 |
| ABHD2 | 978 |
| SLCO3A1 | 979 |
| MCTP2 | 980 |
| MEF2A//LYSMD4 | 981 |
| NIPA2//CYFIP1 | 982 |
| HERC2//HERC2P2//HERC2P3//LOC440248 | 983 |
| MTMR10//MTMR15 | 984 |
| C15orf24 | 985 |
| SLC12A6 | 986 |
| LPCAT4 | 987 |
| INO80 | 988 |
| OIP5 | 989 |
| ZFP106 | 990 |
| CDAN1 | 991 |
| SPG11//ISLR | 992 |
| SPPL2A | 993 |
| GNB5//LOC100129973 | 994 |
| MYO5A | 995 |
| ARPP19 | 996 |
| RAB27A | 997 |
| CCPG1//PIGB//DYX1C1 | 998 |
| BNIP2 | 999 |
| CA12 | 1000 |
| FAM96A | 1001 |
| KIAA0101//CSNK1G1 | 1002 |
| TLE3 | 1003 |
| PARP6 | 1004 |
| NPTN | 1005 |
| MAN2C1 | 1006 |
| IMP3 | 1007 |
| MTHFS | 1008 |
| ST20//C15orf37 | 1009 |
| TMC3 | 1010 |
| AP3B2 | 1011 |
| C15orf40 | 1012 |
| WDR73 | 1013 |
| NTRK3 | 1014 |
| DET1 | 1015 |
| TM2D3 | 1016 |
| WDR90 | 1017 |
| RHOT2//FBXL16 | 1018 |
| TMEM204 | 1019 |
| CRAMP1L//HN1L | 1020 |
| MAPK8IP3 | 1021 |
| TBL3 | 1022 |
| TSC2 | 1023 |
| KCTD5//PRO0461//PDPK1 | 1024 |
| CLUAP1 | 1025 |
| DNASE1 | 1026 |
| DNAJA3 | 1027 |

TABLE 1-continued

| HGNC§ Gene Name | SEQ ID NO |
|---|---|
| CP110 | 1028 |
| C16orf62 | 1029 |
| LYRM1 | 1030 |
| METTL9 | 1031 |
| EEF2K | 1032 |
| POLR3E | 1033 |
| PLK1 | 1034 |
| PRKCB | 1035 |
| IL21R//LOC283888 | 1036 |
| SULT1A2//SULT1A1 | 1037 |
| ATXN2L | 1038 |
| LAT¶ | 1039 |
| KIF22 | 1040 |
| MAZ | 1041 |
| CORO1A//LOC606724 | 1042 |
| ITGAL | 1043 |
| SRCAP//SNORA30 | 1044 |
| ZNF646//ZNF668 | 1045 |
| C16orf67 | 1046 |
| TMEM188 | 1047 |
| LPCAT2 | 1048 |
| CETP | 1049 |
| CKLF | 1050 |
| CMTM1//CKLF | 1051 |
| TMEM208 | 1052 |
| CTCF | 1053 |
| THAP11 | 1054 |
| NUTF2 | 1055 |
| EDC4 | 1056 |
| SLC7A6//SLC7A6OS | 1057 |
| PRMT7 | 1058 |
| SNTB2 | 1059 |
| VPS4A | 1060 |
| DDX19B//DDX19A | 1061 |
| CHST4 | 1062 |
| HP//HPR | 1063 |
| PLCG2 | 1064 |
| KLHL36 | 1065 |
| KIAA0182 | 1066 |
| BANP//RUNDC2C | 1067 |
| TRAPPC2L | 1068 |
| SPG7 | 1069 |
| CDK10 | 1070 |
| TCF25 | 1071 |
| AFG3L1 | 1072 |
| LUC7L | 1073 |
| AXIN1 | 1074 |
| JMJD8 | 1075 |
| LMF1 | 1076 |
| UNKL | 1077 |
| UNKL | 1078 |
| CLCN7 | 1079 |
| MRPS34 | 1080 |
| RNPS1 | 1081 |
| NLRC3 | 1082 |
| TRAP1//DNASE1 | 1083 |
| ADCY9 | 1084 |
| CORO7 | 1085 |
| C16orf72 | 1086 |
| RRN3//LOC653390//LOC730092//LOC100131998 | 1087 |
| XYLT1//LYRM2//ZC3H11A | 1088 |
| DCUN1D3//LYRM1 | 1089 |
| IGSF6//METTL9 | 1090 |
| CDR2//RRN3//LOC100131998//LOC653390 | 1091 |
| COG7 | 1092 |
| GGA2 | 1093 |
| NSMCE1 | 1094 |
| GTF3C1 | 1095 |
| CCDC101//LOC388242 | 1096 |
| C16orf54 | 1097 |
| KCTD13 | 1098 |
| SEPT1 | 1099 |
| ZNF764//ZNF747 | 1100 |
| C16orf58//LOC100128371 | 1101 |
| ITFG1 | 1102 |
| ABCC11//LONP2 | 1103 |
| NUDT21 | 1104 |
| BBS2//OGFOD1 | 1105 |
| CSNK2A2 | 1106 |
| GOT2 | 1107 |
| FAM96B | 1108 |
| FHOD1//SLC9A5 | 1109 |
| ATP6V0D1//LOC100132855 | 1110 |
| GFOD2 | 1111 |
| SLC12A4 | 1112 |
| DPEP3 | 1113 |
| DPEP2 | 1114 |
| CHTF8//HAS3 | 1115 |
| COG8//PDF | 1116 |
| TERF2 | 1117 |
| AARS | 1118 |
| ST3GAL2 | 1119 |
| VAC14//LOC100130894 | 1120 |
| AP1G1 | 1121 |
| WDR59 | 1122 |
| CTRB2//CTRB1 | 1123 |
| TAF1C//ADAD2 | 1124 |
| FBXO31 | 1125 |
| ZCCHC14 | 1126 |
| FAM38A | 1127 |
| CENPBD1 | 1128 |
| TIMM22 | 1129 |
| RPA1 | 1130 |
| DPH1//OVCA2 | 1131 |
| SGSM2 | 1132 |
| ARRB2 | 1133 |
| LOC100130950 | 1134 |
| DNAH2 | 1135 |
| PIGL | 1136 |
| TRPV2 | 1137 |
| MPRIP | 1138 |
| DRG2 | 1139 |
| ALKBH5//FLJ13773 | 1140 |
| SMCR7 | 1141 |
| WSB1 | 1142 |
| TAOK1 | 1143 |
| CPD | 1144 |
| SUZ12P | 1145 |
| RNF135 | 1146 |
| ZNF830 | 1147 |
| TAF15 | 1148 |
| GGNBP2 | 1149 |
| LASP1 | 1150 |
| PSMD3 | 1151 |
| CDC6 | 1152 |
| NBR2 | 1153 |
| TMUB2 | 1154 |
| MGC57346//C17orf69 | 1155 |
| NSF//LOC728806 | 1156 |
| GOSR2 | 1157 |
| NPEPPS//TBC1D3F//LOC440434 | 1158 |
| KPNB1 | 1159 |
| CDK5RAP3 | 1160 |
| ATP5G1 | 1161 |
| UBE2Z | 1162 |
| XYLT2//LOC100130580 | 1163 |
| NOG | 1164 |
| DGKE | 1165 |
| AKAP1 | 1166 |
| TMEM49//CLTC//MIR21 | 1167 |
| CLTC | 1168 |
| CA4 | 1169 |
| C17orf64 | 1170 |
| DCAF7 | 1171 |
| PITPNC1 | 1172 |
| NOL11//SNORA38B | 1173 |
| MAP2K6 | 1174 |
| COG1 | 1175 |
| CD300A | 1176 |
| TMEM104 | 1177 |
| MRPS7 | 1178 |

TABLE 1-continued

| HGNC§ Gene Name | SEQ ID NO |
|---|---|
| KIAA0195 | 1179 |
| TSEN54 | 1180 |
| LLGL2 | 1181 |
| LOC100134934//CDK3 | 1182 |
| MFSD11 | 1183 |
| SEPT9 | 1184 |
| TNRC6C | 1185 |
| TMC8 | 1186 |
| ENGASE | 1187 |
| RPTOR | 1188 |
| GPS1 | 1189 |
| FN3KRP | 1190 |
| TBCD | 1191 |
| GEMIN4 | 1192 |
| GLOD4 | 1193 |
| SLC43A2 | 1194 |
| PRPF8 | 1195 |
| SMG6//C17orf6 | 1196 |
| METT10D//LOC284009 | 1197 |
| SHPK | 1198 |
| TAX1BP3 | 1199 |
| P2RX5 | 1200 |
| MYBBP1A//SPNS2 | 1201 |
| PELP1 | 1202 |
| PFN1 | 1203 |
| ZNF232 | 1204 |
| DHX33 | 1205 |
| DERL2 | 1206 |
| NLRP1//LOC728392 | 1207 |
| ASGR2 | 1208 |
| NEURL4//GPS2//D4S234E | 1209 |
| ZBTB4 | 1210 |
| TP53 | 1211 |
| VAMP2 | 1212 |
| PIK3R5 | 1213 |
| ELAC2 | 1214 |
| NCOR1//C20orf191//LOC100131704 | 1215 |
| ZNF287 | 1216 |
| TOM1L2//LOC246315 | 1217 |
| GRAP//SNORD3B-1//SNORD3B-2//LOC400581 | 1218 |
| ALDOC | 1219 |
| SDF2 | 1220 |
| RAB34 | 1221 |
| PHF12 | 1222 |
| NUFIP2 | 1223 |
| OMG | 1224 |
| EVI2B | 1225 |
| C17orf66//RSL24D1 | 1226 |
| SYNRG//LOC100131822 | 1227 |
| PLXDC1 | 1228 |
| CACNB1 | 1229 |
| PGAP3 | 1230 |
| MED24 | 1231 |
| NR1D1//THRA | 1232 |
| CCR7 | 1233 |
| STAT5B//STAT5A | 1234 |
| FAM134C | 1235 |
| VAT1 | 1236 |
| DUSP3 | 1237 |
| C17orf65//ASB16 | 1238 |
| UBTF | 1239 |
| GPATCH8 | 1240 |
| MAP3K14//LOC100133991 | 1241 |
| OSBPL7 | 1242 |
| SLC35B1 | 1243 |
| TOB1 | 1244 |
| COX11//TOM1L1 | 1245 |
| VEZF1 | 1246 |
| SFRS1//FLJ44342 | 1247 |
| SEPT4 | 1248 |
| MED13//LOC100129112 | 1249 |
| LIMD2//MAP3K3 | 1250 |
| STRADA | 1251 |
| FTSJ3 | 1252 |

TABLE 1-continued

| HGNC§ Gene Name | SEQ ID NO |
|---|---|
| CD79B | 1253 |
| ICAM2 | 1254 |
| ERN1 | 1255 |
| TEX2 | 1256 |
| LRRC37A3//LRRC37A2//LRRC37A//ARL17P1//LRRC37A4//LOC100294335//LOC644397 | 1257 |
| GNA13 | 1258 |
| WIPI1//ARSG | 1259 |
| FAM20A | 1260 |
| NAT9 | 1261 |
| GGA3 | 1262 |
| H3F3B//H3F3C | 1263 |
| EXOC7 | 1264 |
| SFRS2 | 1265 |
| TMC6//LOC100131096 | 1266 |
| USP36 | 1267 |
| CD7 | 1268 |
| RAB31 | 1269 |
| VAPA | 1270 |
| SEH1L | 1271 |
| HQ0644/PRO0644 | 1272 |
| RNMT | 1273 |
| RNF138 | 1274 |
| GALNT1 | 1275 |
| ELP2 | 1276 |
| PIK3C3 | 1277 |
| SLC14A2 | 1278 |
| ME2 | 1279 |
| SERPINB2//SERPINB10 | 1280 |
| ZNF407 | 1281 |
| ZNF236 | 1282 |
| NFATC1//LOC100127994 | 1283 |
| ENOSF1//TYMS | 1284 |
| MYOM1 | 1285 |
| AFG3L2 | 1286 |
| ABHD3 | 1287 |
| OSBPL1A | 1288 |
| CDH2 | 1289 |
| DSC1 | 1290 |
| PSTPIP2 | 1291 |
| C18orf32 | 1292 |
| MBD2//SNORA37 | 1293 |
| PIGN | 1294 |
| TMX3 | 1295 |
| PQLC1 | 1296 |
| GZMM | 1297 |
| ARID3A | 1298 |
| CIRBP | 1299 |
| DAZAP1 | 1300 |
| SPPL2B | 1301 |
| NFIC | 1302 |
| VAV1 | 1303 |
| ARHGEF18//LOC100128573 | 1304 |
| STXBP2//LOC554363//LOC100131801 | 1305 |
| C19orf59 | 1306 |
| ZNF317 | 1307 |
| ILF3 | 1308 |
| SMARCA4 | 1309 |
| PRKCSH | 1310 |
| IER2 | 1311 |
| CCDC130 | 1312 |
| DCAF15 | 1313 |
| IL27RA | 1314 |
| KLF2 | 1315 |
| SIN3B | 1316 |
| DDA1 | 1317 |
| GTPBP3 | 1318 |
| FAM129C | 1319 |
| FCHO1 | 1320 |
| ARRDC2 | 1321 |
| IFI30 | 1322 |
| C19orf60 | 1323 |
| CRTC1//MAML2 | 1324 |
| RFXANK//MEF2B//LOC729991 | 1325 |

TABLE 1-continued

| HGNC§ Gene Name | SEQ ID NO |
|---|---|
| ZNF101 | 1326 |
| ZNF738 | 1327 |
| ZNF257//ZNF492//ZNF99//ZNF98//LOC646864 | 1328 |
| C19orf2 | 1329 |
| KIAA0355//FLJ21369 | 1330 |
| USF2 | 1331 |
| TMEM147 | 1332 |
| LIN37//PSENEN | 1333 |
| C19orf55 | 1334 |
| TBCB//POLR2I | 1335 |
| ZNF382 | 1336 |
| ZNF568 | 1337 |
| ZNF420 | 1338 |
| ZNF383 | 1339 |
| CCDC97 | 1340 |
| ZNF574 | 1341 |
| CD177 | 1342 |
| ZNF230//ZNF222 | 1343 |
| VASP | 1344 |
| GRWD1 | 1345 |
| FLT3LG | 1346 |
| ZNF175 | 1347 |
| NCRNA00085 | 1348 |
| PPP2R1A | 1349 |
| ZNF808//ZNF578//ZNF611 | 1350 |
| LENG8 | 1351 |
| FCAR | 1352 |
| RPL28 | 1353 |
| U2AF2 | 1354 |
| LOC100288114//MGC9913 | 1355 |
| ZFP28 | 1356 |
| ZNF460 | 1357 |
| ZNF549 | 1358 |
| ZNF211 | 1359 |
| ZNF587//ZNF417 | 1360 |
| ZNF274 | 1361 |
| ZNF544 | 1362 |
| ZNF8 | 1363 |
| TRIM28 | 1364 |
| C19orf6 | 1365 |
| C19orf34 | 1366 |
| GNG7 | 1367 |
| AES | 1368 |
| EEF2//SNORD37 | 1369 |
| PLIN5//LRG1 | 1370 |
| PLIN3 | 1371 |
| PTPRS | 1372 |
| SAFB2//SAFB | 1373 |
| RANBP3 | 1374 |
| GTF2F1//LOC100130856 | 1375 |
| XAB2 | 1376 |
| ELAVL1 | 1377 |
| ADAMTS10 | 1378 |
| FBXL12 | 1379 |
| DNMT1 | 1380 |
| TYK2 | 1381 |
| KEAP1 | 1382 |
| KRI1 | 1383 |
| TMEM205//hCG_29977 | 1384 |
| ZNF563 | 1385 |
| MAN2B1//MORG1 | 1386 |
| C19orf56 | 1387 |
| DHPS | 1388 |
| TNPO2//SNORD41 | 1389 |
| LPHN1 | 1390 |
| NDUFB7 | 1391 |
| AKAP8 | 1392 |
| AKAP8L | 1393 |
| CHERP//C19orf44//CALR3 | 1394 |
| INSL3//JAK3 | 1395 |
| IL12RB1 | 1396 |
| UPK1A | 1397 |
| TYROBP | 1398 |
| ZNF529 | 1399 |

TABLE 1-continued

| HGNC§ Gene Name | SEQ ID NO |
|---|---|
| ZNF461 | 1400 |
| ZNF607 | 1401 |
| YIF1B | 1402 |
| PRR13 | 1403 |
| CEACAM4 | 1404 |
| PLAUR | 1405 |
| TRAPPC6A | 1406 |
| ERCC1//CD3EAP | 1407 |
| RTN2 | 1408 |
| SYMPK | 1409 |
| PGLYRP1 | 1410 |
| NOSIP | 1411 |
| PNKP | 1412 |
| NKG7 | 1413 |
| FPR1 | 1414 |
| ZNF28 | 1415 |
| OSCAR | 1416 |
| MBOAT7 | 1417 |
| LILRA5 | 1418 |
| LILRA4 | 1419 |
| ZNF550//ZNF549 | 1420 |
| ZNF416 | 1421 |
| ZNF256 | 1422 |
| ZNF329 | 1423 |
| FAM110A | 1424 |
| ITPA | 1425 |
| CDC25B | 1426 |
| CDS2 | 1427 |
| CRLS1 | 1428 |
| CSRP2BP | 1429 |
| SEC23B | 1430 |
| SLC24A3 | 1431 |
| HCK | 1432 |
| ASXL1 | 1433 |
| ACSS2 | 1434 |
| C20orf4 | 1435 |
| TGIF2 | 1436 |
| C20orf24//SLA2 | 1437 |
| RPN2//EEF1A2 | 1438 |
| CTNNBL1 | 1439 |
| ACTR5 | 1440 |
| PPP1R16B | 1441 |
| DHX35 | 1442 |
| PLCG1 | 1443 |
| MYBL2 | 1444 |
| SYS1//SYS1-DBNDD2//DBNDD2 | 1445 |
| DNTTIP1 | 1446 |
| CTSA | 1447 |
| MMP9//LOC100128028 | 1448 |
| DDX27 | 1449 |
| SLC9A8 | 1450 |
| RNF114 | 1451 |
| PTPN1 | 1452 |
| TSHZ2 | 1453 |
| PFDN4 | 1454 |
| CSTF1 | 1455 |
| CASS4 | 1456 |
| GNAS | 1457 |
| C20orf177 | 1458 |
| CDH26 | 1459 |
| C20orf197 | 1460 |
| LOC284757 | 1461 |
| ARFGAP1 | 1462 |
| PRPF6 | 1463 |
| NSFL1C | 1464 |
| SIRPD | 1465 |
| SIRPG//SIRPA | 1466 |
| RNF24 | 1467 |
| RASSF2 | 1468 |
| TMX4 | 1469 |
| JAG1 | 1470 |
| C20orf74 | 1471 |
| C20orf3 | 1472 |
| C20orf112 | 1473 |
| CDK5RAP1 | 1474 |
| AHCY | 1475 |

TABLE 1-continued

| HGNC§ Gene Name | SEQ ID NO |
|---|---|
| GGT7 | 1476 |
| EDEM2 | 1477 |
| RBM39//LOC643167 | 1478 |
| BLCAP | 1479 |
| SERINC3//TTPAL | 1480 |
| ZNF335 | 1481 |
| ELMO2 | 1482 |
| B4GALT5 | 1483 |
| DPM1 | 1484 |
| ZFP64 | 1485 |
| ZNF217 | 1486 |
| CTSZ | 1487 |
| SYCP2 | 1488 |
| PSMA7 | 1489 |
| DIDO1 | 1490 |
| YTHDF1 | 1491 |
| CHODL | 1492 |
| BACH1 | 1493 |
| C21orf41//BACH1 | 1494 |
| IL10RB | 1495 |
| IFNAR1 | 1496 |
| IFNGR2 | 1497 |
| SON | 1498 |
| MORC3//DOPEY2 | 1499 |
| DYRK1A | 1500 |
| KCNJ15 | 1501 |
| ETS2 | 1502 |
| RRP1B | 1503 |
| PFKL | 1504 |
| TRPM2 | 1505 |
| ADARB1 | 1506 |
| SAMSN1//LOC388813 | 1507 |
| N6AMT1 | 1508 |
| SYNJ1 | 1509 |
| TMEM50B | 1510 |
| KCNE1 | 1511 |
| PRDM15 | 1512 |
| C2CD2 | 1513 |
| WDR4 | 1514 |
| U2AF1 | 1515 |
| CSTB | 1516 |
| UBE2G2//SUMO3 | 1517 |
| PTTG1IP | 1518 |
| POFUT2 | 1519 |
| MCM3AP | 1520 |
| IL17RA//CECR7 | 1521 |
| C22orf37 | 1522 |
| LZTR1 | 1523 |
| PPIL2//YPEL1 | 1524 |
| CYTSA | 1525 |
| SNRPD3//C22orf13 | 1526 |
| NF2 | 1527 |
| LIMK2 | 1528 |
| SLC5A1 | 1529 |
| MCM5 | 1530 |
| NCF4 | 1531 |
| GGA1 | 1532 |
| SH3BP1//PDXP | 1533 |
| POLR2F//LOC100131530 | 1534 |
| APOBEC3A//APOBEC3B | 1535 |
| APOBEC3D | 1536 |
| ATF4 | 1537 |
| CACNA1I | 1538 |
| ZC3H7B | 1539 |
| CCDC134 | 1540 |
| TSPO | 1541 |
| NUP50 | 1542 |
| TBC1D22A//LOC100289878 | 1543 |
| RP3-402G11.5 | 1544 |
| SAPS2 | 1545 |
| NCAPH2 | 1546 |
| BID | 1547 |
| SLC25A1 | 1548 |
| KLHL22//KRT18 | 1549 |
| PI4KA//PI4KAP1//PI4KAP2//LOC100293141 | 1550 |
| MAPK1 | 1551 |
| ZNF70 | 1552 |
| TPST2 | 1553 |
| SF3A1//CCDC157 | 1554 |
| PES1 | 1555 |
| PIK3IP1 | 1556 |
| PATZ1 | 1557 |
| C22orf30 | 1558 |
| IL2RB | 1559 |
| CSNK1E//LOC400927 | 1560 |
| UNC84B | 1561 |
| CBX7//LOC100128400 | 1562 |
| RPS19BP1 | 1563 |
| MKL1//KIAA1659 | 1564 |
| RANGAP1 | 1565 |
| TCF20 | 1566 |
| LDOC1L | 1567 |
| UNQ6126 | 1568 |
| TUBGCP6 | 1569 |
| SBF1//SBF1P1 | 1570 |
| MSL3 | 1571 |
| MOSPD2 | 1572 |
| BMX//HNRPDL | 1573 |
| PDHA1 | 1574 |
| YY2 | 1575 |
| PDK3 | 1576 |
| GK//GK3P//FTL//LOC652904 | 1577 |
| CXorf59 | 1578 |
| ATP6AP2 | 1579 |
| USP9X//USP9Y | 1580 |
| RP2 | 1581 |
| USP11 | 1582 |
| RBM3 | 1583 |
| FTSJ1 | 1584 |
| WAS | 1585 |
| PLP2 | 1586 |
| TSPYL2//GPR173 | 1587 |
| MAGED2 | 1588 |
| UBQLN2 | 1589 |
| NLGN3 | 1590 |
| ACRC | 1591 |
| UPRT | 1592 |
| CXorf26 | 1593 |
| ATP7A | 1594 |
| DIAPH2 | 1595 |
| CSTF2//RAD21 | 1596 |
| ARMCX3 | 1597 |
| ARMCX5 | 1598 |
| GPRASP1 | 1599 |
| TMEM31 | 1600 |
| TBC1D8B | 1601 |
| MID2 | 1602 |
| DOCK11 | 1603 |
| LONRF3 | 1604 |
| UBE2A | 1605 |
| SH2D1A | 1606 |
| OCRL | 1607 |
| SLC25A14 | 1608 |
| HPRT1 | 1609 |
| CD40LG | 1610 |
| AFF2 | 1611 |
| SSR4//IDH3G | 1612 |
| FAM50A | 1613 |
| DKC1//SNORA36A//SNORA56 | 1614 |
| ARSD | 1615 |
| KAL1 | 1616 |
| CTPS2 | 1617 |
| RPS6KA3 | 1618 |
| BCOR | 1619 |
| MAOB//NAT13 | 1620 |
| ZNF41 | 1621 |
| OTUD5 | 1622 |
| KCND1 | 1623 |
| ZMYM3 | 1624 |
| MAGT1 | 1625 |
| BRWD3 | 1626 |
| TRMT2B | 1627 |

TABLE 1-continued

| HGNC§ Gene Name | SEQ ID NO |
|---|---|
| GLA | 1628 |
| MORF4L2 | 1629 |
| PSMD10 | 1630 |
| ACSL4 | 1631 |
| LAMP2 | 1632 |
| CUL4B | 1633 |
| ODZ1 | 1634 |
| ELF4 | 1635 |
| RAP2C | 1636 |
| FAM127B//FAM127C//FAM127A | 1637 |
| TMEM185A | 1638 |
| ARD1A | 1639 |
| IRAK1 | 1640 |
| DNASE1L1//RPL10 | 1641 |
| SH3KBP1 | 1642 |
| Mitochondrial1 | 1643 |
| Mitochondrial2 | 1644 |
| CCNL2 | 1645 |
| INPP5B | 1646 |
| TLR5 | 1647 |
| ADRB3//GOT1L1 | 1648 |
| NOC2L//SAMD11//LOC401010 | 1649 |
| SHFM1 | 1650 |

§ HUGO Gene Nomenclature Committee
¶ Synonymous with SPNS1//NPIPL2//LOC728741//LOC730153//NPIPL3//SPIN1//LOC728888//LOC100289169//LOC728734//LOC729602//LOC100288442//LOC100288332
*Synonymous with SNURF//IPW//SNORD116-16//SNORD116-18//SNORD116-21//SNORD116-22//SNORD116-17//SNORD116-19//PAR5//PAR-SN//SNORD116-2//SNORD116-25//SNORD116-26//SNORD107//SNORD115-12//SNORD115-5//SNORD116-6//SNORD115-9//SNORD116-11//SNORD116-12//SNORD116-13//SNORD116-28//SNORD116-4//SNORD64//PAR1//SNORD109A//SNORD109B//SNORD116-6//SNORD116-3//SNORD116-9//SNORD115-13//SNORD115-1//SNORD115-14//SNORD115-15//SNORD115-21//SNORD115-10//SNORD115-7//SNORD115-16//SNORD115-40//SNORD115-42//SNORD115-11//SNORD115-29//SNORD115-34//SNORD115-36//SNORD115-4//SNORD115-43//HBII-52-24//SNORD116-5//SNORD116-7//SNORD115-26//SNORD115-30//SNORD116-15//SNORD116-8//SNORD115-2//SNORD115-39//SNORD116-14//SNORD116-20//SNORD115-8//SNORD115-3//SNORD115-38//SNORD115-41//SNORD115-22//SNORD115-44//SNORD116-1//SNORD115-17//SNORD115-18//SNORD115-19//SNORD115-20//SNORD116@

TABLE 2

| HGNC§ Gene Name | SEQ ID NO |
|---|---|
| PRKCZ | 1651 |
| SKI | 1652 |
| RER1 | 1653 |
| TAS1R1 | 1654 |
| VAMP3 | 1655 |
| AGTRAP | 1656 |
| VPS13D | 1657 |
| KLHDC7A | 1658 |
| NBL1//C1orf151 | 1659 |
| MDS2 | 1660 |
| RCAN3 | 1661 |
| LDLRAP1 | 1662 |
| MAN1C1 | 1663 |
| SH3BGRL3 | 1664 |
| DHDDS | 1665 |
| HCRTR1 | 1666 |
| CCDC28B | 1667 |
| LCK | 1668 |
| ZNF362 | 1669 |
| THRAP3 | 1670 |
| PPIE//CCDC25 | 1671 |
| CAP1 | 1672 |
| CTPS | 1673 |
| C1orf84 | 1674 |
| FAAH | 1675 |
| DMBX1 | 1676 |
| CYP4B1 | 1677 |
| BTF3L4 | 1678 |
| LRRC42 | 1679 |
| C1orf175//TTC4 | 1680 |

TABLE 2-continued

| HGNC§ Gene Name | SEQ ID NO |
|---|---|
| TMEM61 | 1681 |
| FPGT//TNNI3K | 1682 |
| ACADM | 1683 |
| SPATA1 | 1684 |
| EPHX4 | 1685 |
| RPAP2 | 1686 |
| RPL5//SNORA66//SNORD21//FAM69A | 1687 |
| RTCD1 | 1688 |
| SLC30A7 | 1689 |
| RNPC3//AMY2B | 1690 |
| CELSR2 | 1691 |
| AHCYL1 | 1692 |
| CEPT1//DRAM2 | 1693 |
| CHIA | 1694 |
| LIX1L | 1695 |
| UPF0627 | 1696 |
| MRPS21 | 1697 |
| TNFAIP8L2 | 1698 |
| SMCP | 1699 |
| DCST1 | 1700 |
| RAG1AP1 | 1701 |
| C1orf182 | 1702 |
| HAPLN2 | 1703 |
| NTRK1 | 1704 |
| CD1E | 1705 |
| TOMM40L//NR1I3 | 1706 |
| POU2F1 | 1707 |
| TIPRL | 1708 |
| SFT2D2 | 1709 |
| CACNA1E | 1710 |
| SMG7 | 1711 |
| OCLM | 1712 |
| RGS2 | 1713 |
| ZC3H11A//RP11-74E24.2 | 1714 |
| MFSD4 | 1715 |
| IL20 | 1716 |
| RPS6KC1 | 1717 |
| C1orf95 | 1718 |
| ARF1 | 1719 |
| GALNT2 | 1720 |
| TNFRSF4 | 1721 |
| NADK | 1722 |
| FLJ14100//C1orf86 | 1723 |
| GPR153 | 1724 |
| RERE | 1725 |
| SLC2A7 | 1726 |
| SDHB | 1727 |
| RNF186 | 1728 |
| DDOST | 1729 |
| GPN2 | 1730 |
| RPA2 | 1731 |
| PEF1 | 1732 |
| PTP4A2 | 1733 |
| TRIM62 | 1734 |
| PHC2 | 1735 |
| LSM10 | 1736 |
| MRPS15 | 1737 |
| RRAGC | 1738 |
| COL9A2 | 1739 |
| TESK2 | 1740 |
| NRD1 | 1741 |
| KTI12 | 1742 |
| CC2D1B | 1743 |
| YIPF1 | 1744 |
| JAK1 | 1745 |
| SLC35D1 | 1746 |
| DIRAS3 | 1747 |
| ZZZ3 | 1748 |
| GNG5 | 1749 |
| ZNHIT6 | 1750 |
| ODF2L | 1751 |
| SEP15 | 1752 |
| BARHL2 | 1753 |
| GCLM | 1754 |
| CLCC1//GPSM2//C1orf62 | 1755 |

TABLE 2-continued

| HGNC§ Gene Name | SEQ ID NO |
|---|---|
| SORT1 | 1756 |
| SLC16A4 | 1757 |
| PHTF1 | 1758 |
| RSBN1 | 1759 |
| DENND2C//BCAS2 | 1760 |
| CD58 | 1761 |
| SPAG17//WDR3 | 1762 |
| REG4//NBPF7 | 1763 |
| RP11-94I2.2//NBPF16//NBPF11//NBPF15//NBPF8//NBPF20//NBPF10//NBPF14//NBPF1//LOC100288142//NBPF12//KIAA1245//LOC100290137 | 1764 |
| APH1A | 1765 |
| POGZ | 1766 |
| TDRKH | 1767 |
| THEM4 | 1768 |
| S100A11 | 1769 |
| CRNN | 1770 |
| SPRR2C | |
| S100A12 | 1771 |
| S100A8 | 1772 |
| GATAD2B//PLIN2 | 1773 |
| DENND4B | 1774 |
| PBXIP1 | 1775 |
| PYGO2 | 1776 |
| SHC1 | 1777 |
| DCST2 | 1778 |
| GBA//GBAP | 1779 |
| ASH1L | 1780 |
| RIT1 | 1781 |
| MEF2D | 1782 |
| AIM2 | 1783 |
| COPA | 1784 |
| DEDD | 1785 |
| TADA1L | 1786 |
| GPA33 | 1787 |
| CD247 | 1788 |
| F5 | 1789 |
| PIGC | 1790 |
| KIAA0040 | 1791 |
| TOR1AIP2//TOR1AIP1//IFRG15 | 1792 |
| STX6//KIAA1614 | 1793 |
| EDEM3 | 1794 |
| UCHL5 | 1795 |
| DENND1B | 1796 |
| DDX59 | 1797 |
| KIF21B | 1798 |
| ARL8A | 1799 |
| CYB5R1 | 1800 |
| MYBPH | 1801 |
| CHI3L1 | 1802 |
| PIK3C2B//LOC100130573 | 1803 |
| NUAK2 | 1804 |
| NUCKS1 | 1805 |
| FAIM3 | 1806 |
| PLXNA2 | 1807 |
| SLC30A1 | 1808 |
| LPGAT1 | 1809 |
| ANGEL2 | 1810 |
| RAB3GAP2//AURKAPS1//AURKA//SNORA36B | 1811 |
| TP53BP2 | 1812 |
| NVL | 1813 |
| TMEM63A | 1814 |
| PARP1 | 1815 |
| ITPKB | 1816 |
| TARBP1 | 1817 |
| CHML | 1818 |
| AKT3 | 1819 |
| SMYD3 | 1820 |
| AHCTF1 | 1821 |
| OR1C1 | 1822 |
| NCOA1 | 1823 |
| HADHB | 1824 |
| ABHD1//PREB | 1825 |
| SPAST | 1826 |
| SLC30A6//DDX50 | 1827 |
| CRIPT | 1828 |
| MSH2 | 1829 |
| FOXN2 | 1830 |
| CCDC104 | 1831 |
| VRK2 | 1832 |
| AHSA2//USP34 | 1833 |
| OTX1 | 1834 |
| AFTPH | 1835 |
| CEP68 | 1836 |
| PLEK | 1837 |
| ANXA4 | 1838 |
| MXD1 | 1839 |
| NAGK | 1840 |
| SMYD5//NOTO | 1841 |
| MTHFD2 | 1842 |
| TTC31 | 1843 |
| SEMA4F | 1844 |
| TMSB10 | 1845 |
| SH2D6 | 1846 |
| GNLY | 1847 |
| KCNIP3 | 1848 |
| CNNM4 | 1849 |
| CNNM3 | 1850 |
| ZAP70 | 1851 |
| LIPT1//MRPL30 | 1852 |
| MAP4K4 | 1853 |
| IL1R2 | 1854 |
| IL1R1 | 1855 |
| IL18R1 | 1856 |
| POLR1B | 1857 |
| CHCHD5 | 1858 |
| IL1RN | 1859 |
| PSD4 | 1860 |
| DDX18 | 1861 |
| INSIG2 | 1862 |
| TMEM177//LOC100125918 | 1863 |
| RALB | 1864 |
| PROC | 1865 |
| GPR17//LOC100291428//LIMS2 | 1866 |
| IMP4 | 1867 |
| FAM123C | 1868 |
| ACVR2A | 1869 |
| MBD5 | 1870 |
| LYPD6B | 1871 |
| SLC4A10 | 1872 |
| UBR3 | 1873 |
| HAT1 | 1874 |
| ITGA6 | 1875 |
| ZAK | 1876 |
| OSBPL6 | 1877 |
| PLEKHA3 | 1878 |
| ZC3H15 | 1879 |
| COL3A1 | 1880 |
| GLS | 1881 |
| OBFC2A | 1882 |
| COQ10B | 1883 |
| MARS2 | 1884 |
| CFLAR | 1885 |
| NOP58 | 1886 |
| FAM117B | 1887 |
| CYP20A1 | 1888 |
| FASTKD2 | 1889 |
| PIKFYVE | 1890 |
| C2orf62 | 1891 |
| SLC11A1 | 1892 |
| AGFG1 | 1893 |
| CHRNG | 1894 |
| EIF4E2 | 1895 |
| TRPM8 | 1896 |
| LRRFIP1 | 1897 |
| GAL3ST2 | 1898 |

TABLE 2-continued

| HGNC§ Gene Name | SEQ ID NO |
|---|---|
| TMEM18 | 1899 |
| LAPTM4A | 1900 |
| SF3B14 | 1901 |
| TP53I3 | 1902 |
| UNQ2999 | 1903 |
| GPR113//SELI | 1904 |
| MPV17 | 1905 |
| PPM1G | 1906 |
| NLRC4 | 1907 |
| CDC42EP3 | 1908 |
| HNRPLL | 1909 |
| COX7A2L | 1910 |
| KCNG3 | 1911 |
| CALM2//C2orf61 | 1912 |
| BCL11A | 1913 |
| XPO1 | 1914 |
| NAT8B | 1915 |
| DUSP11 | 1916 |
| MOGS | 1917 |
| SNRNP200 | 1918 |
| SEMA4C | 1919 |
| MITD1 | 1920 |
| IL1A | 1921 |
| SLC35F5 | 1922 |
| CCDC93 | 1923 |
| CLASP1 | 1924 |
| SAP130 | 1925 |
| YSK4 | 1926 |
| GTDC1 | 1927 |
| ORC4L | 1928 |
| NR4A2//FLJ46875 | 1929 |
| DPP4 | 1930 |
| GALNT3 | 1931 |
| SCN7A | 1932 |
| FRZB | 1933 |
| STK17B | 1934 |
| CLK1//PPIL3 | 1935 |
| MPP4 | 1936 |
| INO80D | 1937 |
| KLF7 | 1938 |
| FAM119A | 1939 |
| NGEF | 1940 |
| ARL4C | 1941 |
| RAB17 | 1942 |
| HDLBP | 1943 |
| LRRN1 | 1944 |
| SETD5 | 1945 |
| IRAK2 | 1946 |
| C3orf42 | 1947 |
| TSEN2 | 1948 |
| NR2C2//MRPS25 | 1949 |
| UBE2E1 | 1950 |
| C3orf35 | 1951 |
| SNRK | 1952 |
| ZNF197 | 1953 |
| GNAI2 | 1954 |
| ALAS1 | 1955 |
| PRKCD | 1956 |
| CACNA1D | 1957 |
| PXK | 1958 |
| PTPRG | 1959 |
| ATXN7 | 1960 |
| SLC35A5 | 1961 |
| SLC15A2 | 1962 |
| CCDC48 | 1963 |
| DNAJC13 | 1964 |
| CLDN18 | 1965 |
| GYG1 | 1966 |
| SELT | 1967 |
| MED12L | 1968 |
| RAP2B | 1969 |
| MYNN | 1970 |
| ABCF3 | 1971 |
| VPS8 | 1972 |
| HRG | 1973 |
| EIF4A2//SNORA4 | 1974 |
| LPP | 1975 |
| CCDC50 | 1976 |
| LOC152217 | 1977 |
| TADA3L | 1978 |
| SEC13 | 1979 |
| TIMP4 | 1980 |
| METTL6 | 1981 |
| DAZL//DAZ4//DAZ3//DAZ2 | 1982 |
| SATB1//TBC1D5 | 1983 |
| SCN10A | 1984 |
| SEC22C | 1985 |
| ZDHHC3 | 1986 |
| ZDHHC3 | 1987 |
| SLC6A20 | 1988 |
| UQCRC1 | 1989 |
| PRKAR2A | 1990 |
| IMPDH2 | 1991 |
| CCDC71 | 1992 |
| UBA7 | 1993 |
| CAMKV | 1994 |
| WDR82 | 1995 |
| LMOD3 | 1996 |
| FOXP1 | 1997 |
| MORC1 | 1998 |
| ATG3 | 1999 |
| GSK3B//LOC100129275 | 2000 |
| HCLS1 | 2001 |
| KPNA1 | 2002 |
| PTPLB | 2003 |
| C3orf22 | 2004 |
| RPN1 | 2005 |
| KIAA1257//ACAD9//LOC100132731 | 2006 |
| FOXL2 | 2007 |
| MECOM | 2008 |
| PLD1 | 2009 |
| GNB4 | 2010 |
| MRPL47 | 2011 |
| KLHL6 | 2012 |
| THPO | 2013 |
| ETV5 | 2014 |
| BCL6//LOC100131635 | 2015 |
| ATP13A5 | 2016 |
| TMEM44 | 2017 |
| KIAA1530 | 2018 |
| TACC3 | 2019 |
| CNO | 2020 |
| BST1 | 2021 |
| KLF3 | 2022 |
| TMEM33//DCAF4L1 | 2023 |
| KIT | 2024 |
| ENAM | 2025 |
| FAM47E//STBD1 | 2026 |
| ENOPH1 | 2027 |
| PDLIM5 | 2028 |
| CCDC109B//HIGD1A//CCDC13 | 2029 |
| EGF | 2030 |
| PCDH10 | 2031 |
| RAB33B | 2032 |
| TMEM184C | 2033 |
| RBM46 | 2034 |
| GRIA2 | 2035 |
| C4orf39 | 2036 |
| KLHL2 | 2037 |
| TLL1 | 2038 |
| F11 | 2039 |
| SLBP | 2040 |
| HAUS3//POLN | 2041 |
| PPARGC1A | 2042 |
| TLR10 | 2043 |
| C4orf34 | 2044 |
| TXK | 2045 |
| RPL21P44 | |
| KDR | 2046 |
| RCHY1 | 2047 |
| CNOT6L | 2048 |

TABLE 2-continued

| HGNC§ Gene Name | SEQ ID NO |
|---|---|
| PLAC8 | 2049 |
| HPSE | 2050 |
| GPRIN3 | 2051 |
| PPA2 | 2052 |
| COL25A1 | 2053 |
| C4orf3 | 2054 |
| QRFPR | 2055 |
| MFSD8 | 2056 |
| MAP9 | 2057 |
| PDGFC | 2058 |
| TKTL2 | 2059 |
| ACSL1 | 2060 |
| SUB1//TMEM183A | 2061 |
| CARD6 | 2062 |
| MCCC2 | 2063 |
| TNPO1 | 2064 |
| PDE8B | 2065 |
| PAPD4 | 2066 |
| THBS4 | 2067 |
| FAM151B | 2068 |
| RASGRF2 | 2069 |
| SNX2 | 2070 |
| LMNB1//PCIF1 | 2071 |
| MEGF10 | 2072 |
| LEAP2 | 2073 |
| TCF7 | 2074 |
| KDM3B | 2075 |
| CXXC5 | 2076 |
| SLC4A9 | 2077 |
| ANKHD1-EIF4EBP3//ANKHD1//EIF4EBP3 | 2078 |
| KIAA0141 | 2079 |
| GRPEL2 | 2080 |
| MFAP3 | 2081 |
| GABRA6 | 2082 |
| GABRA1 | 2083 |
| DOCK2 | 2084 |
| RANBP17//USP12 | 2085 |
| ERGIC1 | 2086 |
| ATP6V0E1//SNORA74B | |
| ZNF346 | 2087 |
| NSD1 | 2088 |
| CLPTM1L | 2089 |
| UGT3A1 | 2090 |
| GDNF | 2091 |
| TTC33 | 2092 |
| hCG_2039148 | |
| MOCS2 | 2093 |
| SLC38A9 | 2094 |
| CCDC125 | 2095 |
| ANKRA2 | 2096 |
| HAPLN1 | 2097 |
| CCNH | 2098 |
| TMEM161B | 2099 |
| MBLAC2 | 2100 |
| MCTP1 | 2101 |
| TICAM2//TMED7//TMED7-TICAM2 | 2102 |
| KIF3A | 2103 |
| C5orf15 | 2104 |
| SKP1 | 2105 |
| CXCL14 | 2106 |
| KLHL3 | 2107 |
| CD14 | 2108 |
| YIPF5 | 2109 |
| LARS | 2110 |
| DCTN4 | 2111 |
| CCDC69 | 2112 |
| ATOX1 | 2113 |
| TIMD4 | 2114 |
| ADAM19 | 2115 |
| SLIT3 | 2116 |
| RNF44 | 2117 |
| DOK3 | 2118 |
| MGAT4B//SQSTM1 | 2119 |
| C5orf45//SQSTM1 | 2120 |
| RASGEF1C | 2121 |
| MGAT1 | 2122 |
| IRF4 | 2123 |
| HIVEP1 | 2124 |
| E2F3 | 2125 |
| HIST1H4I | 2126 |
| HIST1H2BM | 2127 |
| MOG | 2128 |
| ZNRD1//NCRNA00171 | 2129 |
| TRIM15 | 2130 |
| HCG27 | 2131 |
| BAT2//SNORA38 | 2132 |
| CYP21A2 | 2133 |
| ITPR3 | 2134 |
| MAPK14 | 2135 |
| MAPK13 | 2136 |
| PNPLA1 | 2137 |
| SFRS3 | 2138 |
| CDKN1A | 2139 |
| FOXP4 | 2140 |
| CUL9 | 2141 |
| RUNX2 | 2142 |
| ZNF451 | 2143 |
| SOBP | 2144 |
| C6orf182 | 2145 |
| KIAA1919 | 2146 |
| RWDD1 | 2147 |
| KPNA5 | 2148 |
| TPD52L1 | 2149 |
| ARG1 | 2150 |
| RAB32 | 2151 |
| ARID1B | 2152 |
| SLC22A3 | 2153 |
| SERPINB1 | 2154 |
| C6orf146 | 2155 |
| GCM2 | 2156 |
| ATXN1 | 2157 |
| DCDC2//KAAG1 | 2158 |
| HIST1H3I | 2159 |
| HIST1H4L | 2160 |
| GABBR1 | 2161 |
| RNA243 | |
| DDAH2 | 2162 |
| CLIC1 | 2163 |
| NEU1 | 2164 |
| RXRB | 2165 |
| VPS52 | 2166 |
| TCP11 | 2167 |
| CLPS | 2168 |
| PGC | 2169 |
| ZNF318 | 2170 |
| YIPF3 | 2171 |
| MRPL14 | 2172 |
| PLA2G7 | 2173 |
| PKHD1 | 2174 |
| IL17F | 2175 |
| HTR1B | 2176 |
| GABRR2 | 2177 |
| UBE2J1 | 2178 |
| BACH2 | 2179 |
| MCM9 | 2180 |
| VNN1 | 2181 |
| IL20RA | 2182 |
| FLJ27255 | 2183 |
| T | 2184 |
| RPS6KA2 | 2185 |
| HGC6.3 | 2186 |
| UNC84A//C7orf20 | 2187 |
| SDK1 | 2188 |
| ZDHHC4 | 2189 |
| C7orf26 | 2190 |
| GLCCI1//tcag7.903 | 2191 |
| GPNMB | 2192 |
| CCDC126 | 2193 |
| WIPF3//ZNRF2//LOC441208 | 2194 |
| GPR141 | 2195 |
| STARD3NL | 2196 |

TABLE 2-continued

| HGNC§ Gene Name | SEQ ID NO |
|---|---|
| POU6F2 | 2197 |
| CDC2L5 | 2198 |
| ZMIZ2 | 2199 |
| UPP1 | 2200 |
| ZNF273 | 2201 |
| KCTD7//RABGEF1 | 2202 |
| RABGEF1//tcag7.967//tcag7.951//KCTD7//LOC100293333 | 2203 |
| CCDC132 | 2204 |
| PVRIG//PILRB//STAG3 | 2205 |
| PILRB//PVRIG//STAG3 | 2206 |
| C7orf51 | 2207 |
| GNB2 | 2208 |
| LRRC17 | 2209 |
| LRRN3 | 2210 |
| CFTR | 2211 |
| LSM8 | 2212 |
| LUC7L2 | 2213 |
| MGAM//LOC100124692 | 2214 |
| GIMAP7 | 2215 |
| INSIG1 | 2216 |
| RBM33 | 2217 |
| ICA1 | 2218 |
| FAM126A | 2219 |
| HIBADH | 2220 |
| TRIL | 2221 |
| SCRN1 | 2222 |
| ELMO1 | 2223 |
| INHBA | 2224 |
| CAMK2B | 2225 |
| NPC1L1 | 2226 |
| DDC//LOC100129427 | 2227 |
| NSUN5//NSUN5B//NSUN5C | 2228 |
| CLDN3 | 2229 |
| C7orf23//DMTF1 | 2230 |
| SRI | 2231 |
| BET1 | 2232 |
| MCM7 | 2233 |
| GATS | 2234 |
| ATXN7L1//RINT1//EFCAB10 | 2235 |
| KIAA1549 | 2236 |
| SLC37A3 | 2237 |
| SMARCD3 | 2238 |
| MLL3//BAGE2 | 2239 |
| CLN8 | 2240 |
| MSRA | 2241 |
| PIWIL2 | 2242 |
| NEFM//LOC100129717 | 2243 |
| EPHX2 | 2244 |
| LEPROTL1 | 2245 |
| MAK16//C8orf41 | 2246 |
| AP3M2 | 2247 |
| FNTA | 2248 |
| SGK196 | 2249 |
| UBE2V2 | 2250 |
| FLJ46365 | N/A |
| SNTG1 | 2251 |
| TRIM55 | 2252 |
| C8orf45 | 2253 |
| PREX2 | 2254 |
| PLEKHF2 | 2255 |
| BAALC//FLJ10489 | 2256 |
| TTC35 | 2257 |
| MTBP | 2258 |
| ZHX2 | 2259 |
| RNF139 | 2260 |
| TG | 2261 |
| DENND3//C8orf60 | 2262 |
| TNFRSF10D | 2263 |
| TRIM35 | 2264 |
| GSR | 2265 |
| WHSC1L1 | 2266 |
| PCMTD1//PXDNL | 2267 |
| NCOA2 | 2268 |
| TRAM1//LOC286190 | 2269 |
| RUNX1T1 | 2270 |
| EXT1 | 2271 |
| DDEF1IT1 | 2272 |
| CDC37L1 | 2273 |
| UBE2R2 | 2274 |
| UBAP1//KIF24 | 2275 |
| GALT | 2276 |
| RGP1//GBA2 | 2277 |
| TGFBR1 | 2278 |
| C9orf6//IKBKAP | 2279 |
| IMAGE5303689 | N/A |
| ATP6V1G1 | 2280 |
| TLR4 | 2281 |
| SET | 2282 |
| MRPL41 | 2283 |
| C9orf68 | 2284 |
| HAUS6//SCARNA8 | 2285 |
| KLHL9 | 2286 |
| C9orf82 | 2287 |
| NDUFB6//DFFB | 2288 |
| SIT1 | 2289 |
| FAM108B1 | 2290 |
| TRPM6 | 2291 |
| FRMD3 | 2292 |
| SLC28A3 | 2293 |
| BICD2 | 2294 |
| C9orf84 | 2295 |
| AKNA | 2296 |
| MEGF9 | 2297 |
| C5 | 2298 |
| GOLGA1//SCAI | 2299 |
| SH2D3C | 2300 |
| FAM102A | 2301 |
| FLJ10232 | N/A |
| ASB6 | 2302 |
| BAT2L | 2303 |
| EDF1 | 2304 |
| FBXW5 | 2305 |
| C10orf18 | 2306 |
| FBXO18 | 2307 |
| GATA3 | 2308 |
| CUGBP2 | 2309 |
| VIM | 2310 |
| STAM | 2311 |
| WAC | 2312 |
| BAMBI | 2313 |
| ZNF487//LOC439911 | 2314 |
| ALOX5 | 2315 |
| WDFY4 | 2316 |
| SRGN | 2317 |
| CCDC109A | 2318 |
| FAM149B1//FAM149B2 | 2319 |
| MINPP1 | 2320 |
| PTEN//PTENP1 | 2321 |
| ENTPD1//C10orf131 | 2322 |
| ABCC2 | 2323 |
| SFXN2 | 2324 |
| SHOC2 | 2325 |
| ACSL5 | 2326 |
| BCCIP//DHX32 | 2327 |
| FAM188A | 2328 |
| CUBN | 2329 |
| SVIL//hCG_1783494 | 2330 |
| FAM13C//PHYHIPL | 2331 |
| ATAD1 | 2332 |
| ANKRD22 | 2333 |
| FLJ34077 | N/A |
| COX15 | 2334 |
| ERLIN1 | 2335 |
| ACTR1A | 2336 |
| ABLIM1 | 2337 |
| RAB11FIP2 | 2338 |
| C10orf84 | 2339 |
| PRDX3 | 2340 |
| C10orf119 | 2341 |
| NSMCE4A | 2342 |

TABLE 2-continued

| HGNC§ Gene Name | SEQ ID NO |
|---|---|
| TALDO1//INTS8 | 2343 |
| TNNT3 | 2344 |
| FXC1 | 2345 |
| PDE3B | 2346 |
| DNAJC24 | 2347 |
| PTPRJ//OR4B1 | 2348 |
| C11orf31 | 2349 |
| TMEM109 | 2350 |
| CD6 | 2351 |
| CD5 | 2352 |
| TMEM138 | 2353 |
| POLR2G | 2354 |
| TMEM179B | 2355 |
| NAT11 | 2356 |
| OTUB1 | 2357 |
| RBM14//RBM4 | 2358 |
| AIP | 2359 |
| PPFIA1 | 2360 |
| IL18BP//NUMA1 | 2361 |
| C11orf30 | 2362 |
| C11orf82 | 2363 |
| TMEM126B | 2364 |
| C11orf73 | 2365 |
| PIWIL4 | 2366 |
| LOC100132686 | 2367 |
| PAFAH1B2 | 2368 |
| UBE4A | 2369 |
| TRAPPC4 | 2370 |
| SC5DL | 2371 |
| VWA5A//OR10D1P | 2372 |
| STT3A | 2373 |
| VPS26B | 2374 |
| TRIM21 | 2375 |
| ZBED5 | 2376 |
| SAAL1 | 2377 |
| FANCF | 2378 |
| LIN7C | 2379 |
| PHF21A | 2380 |
| CUGBP1 | 2381 |
| OSBP | 2382 |
| CYBASC3 | 2383 |
| TUT1 | 2384 |
| SLC25A45 | 2385 |
| LTBP3 | 2386 |
| EIF1AD | 2387 |
| GAB2 | 2388 |
| CREBZF | 2389 |
| PICALM | 2390 |
| SLC36A4 | 2391 |
| CCDC82 | 2392 |
| KIAA1826 | 2393 |
| MPZL3 | 2394 |
| MPZL2 | 2395 |
| H2AFX | 2396 |
| SIAE | 2397 |
| ZBTB44 | 2398 |
| HSN2 | 2399 |
| ADIPOR2 | 2400 |
| NCAPD2//SCARNA10//FADS1 | 2401 |
| PTPN6 | 2402 |
| CLEC4D | 2403 |
| CDKN1B | 2404 |
| GOLT1B | 2405 |
| FAR2 | 2406 |
| FGD4 | 2407 |
| TMEM106C | 2408 |
| TMBIM6 | 2409 |
| C12orf62 | 2410 |
| PRR13//PCBP2 | 2411 |
| DGKA | 2412 |
| COQ10A | 2413 |
| TSPAN31 | 2414 |
| CDK4/MARCH9/C3HC4 | 2415 |
| LEMD3 | 2416 |
| IRAK3 | 2417 |
| TMTC3 | 2418 |
| ACTR6 | 2419 |
| TCTN1 | 2420 |
| PXMP2//PGAM5 | 2421 |
| DCP1B | 2422 |
| SLC2A3//SLC2A14 | 2423 |
| C3AR1 | 2424 |
| PLBD1 | 2425 |
| TM7SF3 | 2426 |
| ASB8//PHB | 2427 |
| LMBR1L | 2428 |
| FMNL3//PRPF40B | 2429 |
| AAAS | 2430 |
| NFE2 | 2431 |
| GPR84 | 2432 |
| CD63 | 2433 |
| SARNP//DNAJC14 | 2434 |
| NACA | 2435 |
| CDK4//TSPAN31 | 2436 |
| TMBIM4//LOC100133322 | 2437 |
| IL22 | 2438 |
| LIN7A | 2439 |
| HAL | 2440 |
| APPL2 | 2441 |
| GLTP | 2442 |
| GIT2 | 2443 |
| VPS29 | 2444 |
| PPTC7 | 2445 |
| DDX54//CCDC42B | 2446 |
| SLC24A6 | 2447 |
| SDS | 2448 |
| RBM19 | 2449 |
| MED13L | 2450 |
| C12orf49 | 2451 |
| FBXO21 | 2452 |
| WSB2 | 2453 |
| TAOK3 | 2454 |
| CIT | 2455 |
| RAB35 | 2456 |
| RPLP0 | 2457 |
| PXN | 2458 |
| TRIAP1 | 2459 |
| SFRS9 | 2460 |
| POP5 | 2461 |
| UNQ1887 | 2462 |
| C12orf43 | 2463 |
| ANAPC5 | 2464 |
| KDM2B | 2465 |
| MORN3 | 2466 |
| TMEM120B//RHOF LOC338799 | 2467 |
| DIABLO//B3GNT4 | 2468 |
| VPS33A | 2469 |
| CLIP1 | 2470 |
| PITPNM2 | 2471 |
| EIF2B1 | 2472 |
| CCDC92 | 2473 |
| NCOR2 | 2474 |
| DHX37 | 2475 |
| DDX51 | 2476 |
| POLE | 2477 |
| GOLGA3 | 2478 |
| ZMYM2 | 2479 |
| SPATA13//C1QTNF9 | 2480 |
| NUPL1 | 2481 |
| PAN3//EEF1A1//CHCHD2 | 2482 |
| ALOX5AP | 2483 |
| EEF1DP3 | 2484 |
| KL | 2485 |
| UFM1 | 2486 |
| NARG1L | 2487 |
| ITM2B | 2488 |
| FNDC3A | 2489 |
| CDADC1 | 2490 |
| ARL11 | 2491 |
| LMO7 | 2492 |
| DNAJC3 | 2493 |
| TM9SF2 | 2494 |

TABLE 2-continued

| HGNC§ Gene Name | SEQ ID NO |
|---|---|
| CLYBL | 2495 |
| PCCA | 2496 |
| ABHD13 | 2497 |
| LAMP1 | 2498 |
| TMCO3 | 2499 |
| UPF3A | 2500 |
| ZMYM5//ZMYM2 | 2501 |
| ZDHHC20//LOC728099 | 2502 |
| PARP4 | 2503 |
| MTMR6//LOC646482 | 2504 |
| HSPH1 | 2505 |
| N4BP2L2//CG030 | 2506 |
| ELF1 | 2507 |
| LCP1 | 2508 |
| KPNA3 | 2509 |
| C13orf1 | 2510 |
| DLEU2//DLEU2L | 2511 |
| GUCY1B2 | 2512 |
| INTS6 | 2513 |
| DACH1 | 2514 |
| TBC1D4 | 2515 |
| EDNRB | 2516 |
| UGGT2 | 2517 |
| GPR183 | 2518 |
| LIG4 | 2519 |
| ANKRD10 | 2520 |
| RASA3 | 2521 |
| RNASE2//LOC643332 | 2522 |
| RPGRIP1 | 2523 |
| IRF9 | 2524 |
| TSSK4 | 2525 |
| C14orf21 | 2526 |
| SCFD1 | 2527 |
| FANCM | 2528 |
| ABHD12B | 2529 |
| PTGDR | 2530 |
| FBXO34//KIAA0831 | 2531 |
| C14orf101 | 2532 |
| ACTR10 | 2533 |
| ARID4A | 2534 |
| JKAMP | 2535 |
| HIF1A | 2536 |
| SYNE2 | 2537 |
| EXD2 | 2538 |
| SLC39A9 | 2539 |
| SFRS5 | 2540 |
| PCNX | 2541 |
| SIPA1L1//SNORD56B//LOC145474//LOC283567 | 2542 |
| YLPM1 | 2543 |
| BATF | 2544 |
| FLVCR2//RPS24 | 2545 |
| GPR65 | 2546 |
| TDP1 | 2547 |
| EVL | 2548 |
| ZNF839 | 2549 |
| TDRD9 | 2550 |
| INF2 | 2551 |
| PLD4 | 2552 |
| MTA1//LOC647310//LOC100128343 | 2553 |
| NDRG2 | 2554 |
| DAD1//OR6J1 | 2555 |
| SLC7A8 | 2556 |
| IPO4 | 2557 |
| TM9SF1 | 2558 |
| ADCY4 | 2559 |
| RIPK3 | 2560 |
| EAPP | 2561 |
| BAZ1A | 2562 |
| NFKBIA | 2563 |
| SEC23A | 2564 |
| C14orf104 | 2565 |
| C14orf138 | 2566 |
| SOS2 | 2567 |
| NIN | 2568 |
| PYGL | 2569 |
| CNIH | 2570 |
| DHRS7 | 2571 |
| WDR89 | 2572 |
| ACTN1 | 2573 |
| NUMB | 2574 |
| C14orf43 | 2575 |
| ABCD4 | 2576 |
| KIAA0317 | 2577 |
| NEK9 | 2578 |
| ANGEL1 | 2579 |
| SPTLC2 | 2580 |
| SERPINA6 | 2581 |
| DICER1 | 2582 |
| BCL11B | 2583 |
| ANKRD9 | 2584 |
| PPP1R13B | 2585 |
| AKT1 | 2586 |
| BRF1 | 2587 |
| TUBGCP5 | 2588 |
| SNRPN* | 2589 |
| APBA2 | 2590 |
| MTMR15//MTMR10 | 2591 |
| RYR3 | 2592 |
| BAHD1 | 2593 |
| CHP | 2594 |
| JMJD7-PLA2G4B//JMJD7//PLA2G4B | 2595 |
| HAUS2 | 2596 |
| C15orf63//SERF2 | 2597 |
| B2M | 2598 |
| TRIM69 | 2599 |
| PLDN | 2600 |
| SQRDL | 2601 |
| GALK2 | 2602 |
| USP8 | 2603 |
| GLDN | 2604 |
| MAPK6 | 2605 |
| LACTB | 2606 |
| RAB8B | 2607 |
| APH1B | 2608 |
| USP3//LOC100130855 | 2609 |
| SNX1 | 2610 |
| LBXCOR1//PIAS1//CALML4 | 2611 |
| NEO1 | 2612 |
| MPI | 2613 |
| FBXO22//FBXO22OS | 2614 |
| RCN2 | 2615 |
| FAH | 2616 |
| IL16 | 2617 |
| ABHD2 | 2618 |
| SLCO3A1 | 2619 |
| MCTP2 | 2620 |
| MEF2A//LYSMD4 | 2621 |
| NIPA2//CYFIP1 | 2622 |
| HERC2//HERC2P2//HERC2P3//LOC440248 | 2623 |
| MTMR10//MTMR15 | 2624 |
| C15orf24 | 2625 |
| SLC12A6 | 2626 |
| LPCAT4 | 2627 |
| INO80 | 2628 |
| OIP5 | 2629 |
| ZFP106 | 2630 |
| CDAN1 | 2631 |
| SPG11//ISLR | 2632 |
| SPPL2A | 2633 |
| GNB5//LOC100129973 | 2634 |
| MYO5A | 2635 |
| ARPP19 | 2636 |
| RAB27A | 2637 |
| CCPG1//PIGB//DYX1C1 | 2638 |
| BNIP2 | 2639 |
| CA12 | 2640 |
| FAM96A | 2641 |
| KIAA0101//CSNK1G1 | 2642 |

TABLE 2-continued

| HGNC§ Gene Name | SEQ ID NO |
|---|---|
| TLE3 | 2643 |
| PARP6 | 2644 |
| NPTN | 2645 |
| MAN2C1 | 2646 |
| IMP3 | 2647 |
| MTHFS | 2648 |
| ST20//C15orf37 | 2649 |
| TMC3 | 2650 |
| AP3B2 | 2651 |
| C15orf40 | 2652 |
| WDR73 | 2653 |
| NTRK3 | 2654 |
| DET1 | 2655 |
| TM2D3 | 2656 |
| WDR90 | 2657 |
| RHOT2//FBXL16 | 2658 |
| TMEM204 | 2659 |
| CRAMP1L//HN1L | 2660 |
| MAPK8IP3 | 2661 |
| TBL3 | 2662 |
| TSC2 | 2663 |
| KCTD5//PRO0461//PDPK1 | 2664 |
| CLUAP1 | 2665 |
| DNASE1 | 2666 |
| DNAJA3 | 2667 |
| CP110 | 2668 |
| C16orf62 | 2669 |
| LYRM1 | 2670 |
| METTL9 | 2671 |
| EEF2K | 2672 |
| POLR3E | 2673 |
| PLK1 | 2674 |
| PRKCB | 2675 |
| IL21R//LOC283888 | 2676 |
| SULT1A2//SULT1A1 | 2677 |
| ATXN2L | 2678 |
| LAT¶ | 2679 |
| KIF22 | 2680 |
| MAZ | 2681 |
| CORO1A//LOC606724 | 2682 |
| ITGAL | 2683 |
| SRCAP//SNORA30 | 2684 |
| ZNF646//ZNF668 | 2685 |
| C16orf67 | 2686 |
| TMEM188 | 2687 |
| LPCAT2 | 2688 |
| CETP | 2689 |
| CKLF | 2690 |
| CMTM1//CKLF | 2691 |
| TMEM208 | 2692 |
| CTCF | 2693 |
| THAP11 | 2694 |
| NUTF2 | 2695 |
| EDC4 | 2696 |
| SLC7A6//SLC7A6OS | 2697 |
| PRMT7 | 2698 |
| SNTB2 | 2699 |
| VPS4A | 2700 |
| DDX19B//DDX19A | 2701 |
| CHST4 | 2702 |
| HP//HPR | 2703 |
| PLCG2 | 2704 |
| KLHL36 | 2705 |
| KIAA0182 | 2706 |
| BANP//RUNDC2C | 2707 |
| TRAPPC2L | 2708 |
| SPG7 | 2709 |
| CDK10 | 2710 |
| TCF25 | 2711 |
| AFG3L1 | 2712 |
| LUC7L | 2713 |
| AXIN1 | 2714 |
| JMJD8 | 2715 |
| LMF1 | 2716 |
| UNKL | 2717 |
| UNKL | 2718 |
| CLCN7 | 2719 |
| MRPS34 | 2720 |
| RNPS1 | 2721 |
| NLRC3 | 2722 |
| TRAP1//DNASE1 | 2723 |
| ADCY9 | 2724 |
| CORO7 | 2725 |
| C16orf72 | 2726 |
| RRN3//LOC653390//LOC730092//LOC100131998 | 2727 |
| XYLT1//LYRM2//ZC3H11A | 2728 |
| DCUN1D3//LYRM1 | 2729 |
| IGSF6//METTL9 | 2730 |
| CDR2//RRN3//LOC100131998//LOC653390 | 2731 |
| COG7 | 2732 |
| GGA2 | 2733 |
| NSMCE1 | 2734 |
| GTF3C1 | 2735 |
| CCDC101//LOC388242 | 2736 |
| C16orf54 | 2737 |
| KCTD13 | 2738 |
| SEPT1 | 2739 |
| ZNF764//ZNF747 | 2740 |
| C16orf58//LOC100128371 | 2741 |
| ITFG1 | 2742 |
| ABCC11//LONP2 | 2743 |
| NUDT21 | 2744 |
| BBS2//OGFOD1 | 2745 |
| CSNK2A2 | 2746 |
| GOT2 | 2747 |
| FAM96B | 2748 |
| FHOD1//SLC9A5 | 2749 |
| ATP6V0D1//LOC100132855 | 2750 |
| GFOD2 | 2751 |
| SLC12A4 | 2752 |
| DPEP3 | 2753 |
| DPEP2 | 2754 |
| CHTF8//HAS3 | 2755 |
| COG8//PDF | 2756 |
| TERF2 | 2757 |
| AARS | 2758 |
| ST3GAL2 | 2759 |
| VAC14//LOC100130894 | 2760 |
| AP1G1 | 2761 |
| WDR59 | 2762 |
| CTRB2//CTRB1 | 2763 |
| TAF1C//ADAD2 | 2764 |
| FBXO31 | 2765 |
| ZCCHC14 | 2766 |
| FAM38A | 2767 |
| CENPBD1 | 2768 |
| TIMM22 | 2769 |
| RPA1 | 2770 |
| DPH1//OVCA2 | 2771 |
| SGSM2 | 2772 |
| ARRB2 | 2773 |
| LOC100130950 | 2774 |
| DNAH2 | 2775 |
| PIGL | 2776 |
| TRPV2 | 2777 |
| MPRIP | 2778 |
| DRG2 | 2779 |
| ALKBH5//FLJ13773 | 2780 |
| SMCR7 | 2781 |
| WSB1 | 2782 |
| TAOK1 | 2783 |
| CPD | 2784 |
| SUZ12P | 2785 |
| RNF135 | 2786 |
| ZNF830 | 2787 |
| TAF15 | 2788 |
| GGNBP2 | 2789 |
| LASP1 | 2790 |
| PSMD3 | 2791 |
| CDC6 | 2792 |
| NBR2 | 2793 |

TABLE 2-continued

| HGNC§ Gene Name | SEQ ID NO |
|---|---|
| TMUB2 | 2794 |
| MGC57346//C17orf69 | 2795 |
| NSF//LOC728806 | 2796 |
| GOSR2 | 2797 |
| NPEPPS//TBC1D3F//LOC440434 | 2798 |
| KPNB1 | 2799 |
| CDK5RAP3 | 2800 |
| ATP5G1 | 2801 |
| UBE2Z | 2802 |
| XYLT2//LOC100130580 | 2803 |
| NOG | 2804 |
| DGKE | 2805 |
| AKAP1 | 2806 |
| TMEM49//CLTC//MIR21 | 2807 |
| CLTC | 2808 |
| CA4 | 2809 |
| C17orf64 | 2810 |
| DCAF7 | 2811 |
| PITPNC1 | 2812 |
| NOL11//SNORA38B | 2813 |
| MAP2K6 | 2814 |
| COG1 | 2815 |
| CD300A | 2816 |
| TMEM104 | 2817 |
| MRPS7 | 2818 |
| KIAA0195 | 2819 |
| TSEN54 | 2820 |
| LLGL2 | 2821 |
| LOC100134934//CDK3 | 2822 |
| MFSD11 | 2823 |
| SEPT9 | 2824 |
| TNRC6C | 2825 |
| TMC8 | 2826 |
| ENGASE | 2827 |
| RPTOR | 2828 |
| GPS1 | 2829 |
| FN3KRP | 2830 |
| TBCD | 2831 |
| GEMIN4 | 2832 |
| GLOD4 | 2833 |
| SLC43A2 | 2834 |
| PRPF8 | 2835 |
| SMG6//C17orf6 | 2836 |
| METT10D//LOC284009 | 2837 |
| SHPK | 2838 |
| TAX1BP3 | 2839 |
| P2RX5 | 2840 |
| MYBBP1A//SPNS2 | 2841 |
| PELP1 | 2842 |
| PFN1 | 2843 |
| ZNF232 | 2844 |
| DHX33 | 2845 |
| DERL2 | 2846 |
| NLRP1//LOC728392 | 2847 |
| ASGR2 | 2848 |
| NEURL4//GPS2//D4S234E | 2849 |
| ZBTB4 | 2850 |
| TP53 | 2851 |
| VAMP2 | 2852 |
| PIK3R5 | 2853 |
| ELAC2 | 2854 |
| NCOR1//C20orf191//LOC100131704 | 2855 |
| ZNF287 | 2856 |
| TOM1L2//LOC246315 | 2857 |
| GRAP//SNORD3B-1//SNORD3B-2//LOC400581 | 2858 |
| ALDOC | 2859 |
| SDF2 | 2860 |
| RAB34 | 2861 |
| PHF12 | 2862 |
| NUFIP2 | 2863 |
| OMG | 2864 |
| EVI2B | 2865 |
| C17orf66//RSL24D1 | 2866 |
| SYNRG//LOC100131822 | 2867 |
| PLXDC1 | 2868 |
| CACNB1 | 2869 |
| PGAP3 | 2870 |
| MED24 | 2871 |
| NR1D1//THRA | 2872 |
| CCR7 | 2873 |
| STAT5B//STAT5A | 2874 |
| FAM134C | 2875 |
| VAT1 | 2876 |
| DUSP3 | 2877 |
| C17orf65//ASB16 | 2878 |
| UBTF | 2879 |
| GPATCH8 | 2880 |
| MAP3K14//LOC100133991 | 2881 |
| OSBPL7 | 2882 |
| SLC35B1 | 2883 |
| TOB1 | 2884 |
| COX11//TOM1L1 | 2885 |
| VEZF1 | 2886 |
| SFRS1//FLJ44342 | 2887 |
| SEPT4 | 2888 |
| MED13//LOC100129112 | 2889 |
| LIMD2//MAP3K3 | 2890 |
| STRADA | 2891 |
| FTSJ3 | 2892 |
| CD79B | 2893 |
| ICAM2 | 2894 |
| ERN1 | 2895 |
| TEX2 | 2896 |
| LRRC37A3//LRRC37A2//LRRC37A//ARL17P1//LRRC37A4//LOC100294335//LOC644397 | 2897 |
| GNA13 | 2898 |
| WIPI1//ARSG | 2899 |
| FAM20A | 2900 |
| NAT9 | 2901 |
| GGA3 | 2902 |
| H3F3B//H3F3C | 2903 |
| EXOC7 | 2904 |
| SFRS2 | 2905 |
| TMC6//LOC100131096 | 2906 |
| USP36 | 2907 |
| CD7 | 2908 |
| RAB31 | 2909 |
| VAPA | 2910 |
| SEH1L | 2911 |
| HQ0644/PRO0644 | 2912 |
| RNMT | 2913 |
| RNF138 | 2914 |
| GALNT1 | 2915 |
| ELP2 | 2916 |
| PIK3C3 | 2917 |
| SLC14A2 | 2918 |
| ME2 | 2919 |
| SERPINB2//SERPINB10 | 2920 |
| ZNF407 | 2921 |
| ZNF236 | 2922 |
| NFATC1//LOC100127994 | 2923 |
| ENOSF1//TYMS | 2924 |
| MYOM1 | 2925 |
| AFG3L2 | 2926 |
| ABHD3 | 2927 |
| OSBPL1A | 2928 |
| CDH2 | 2929 |
| DSC1 | 2930 |
| PSTPIP2 | 2931 |
| C18orf32 | 2932 |
| MBD2//SNORA37 | 2933 |
| PIGN | 2934 |
| TMX3 | 2935 |
| PQLC1 | 2936 |
| GZMM | 2937 |
| ARID3A | 2938 |
| CIRBP | 2939 |

TABLE 2-continued

| HGNC§ Gene Name | SEQ ID NO |
|---|---|
| DAZAP1 | 2940 |
| SPPL2B | 2941 |
| NFIC | 2942 |
| VAV1 | 2943 |
| ARHGEF18//LOC100128573 | 2944 |
| STXBP2//LOC554363//LOC100131801 | 2945 |
| C19orf59 | 2946 |
| ZNF317 | 2947 |
| ILF3 | 2948 |
| SMARCA4 | 2949 |
| PRKCSH | 2950 |
| IER2 | 2951 |
| CCDC130 | 2952 |
| DCAF15 | 2953 |
| IL27RA | 2954 |
| KLF2 | 2955 |
| SIN3B | 2956 |
| DDA1 | 2957 |
| GTPBP3 | 2958 |
| FAM129C | 2959 |
| FCHO1 | 2960 |
| ARRDC2 | 2961 |
| IFI30 | 2962 |
| C19orf60 | 2963 |
| CRTC1//MAML2 | 2964 |
| RFXANK//MEF2B//LOC729991 | 2965 |
| ZNF101 | 2966 |
| ZNF738 | 2967 |
| ZNF257//ZNF492//ZNF99//ZNF98//LOC646864 | 2968 |
| C19orf2 | 2969 |
| KIAA0355//FLJ21369 | 2970 |
| USF2 | 2971 |
| TMEM147 | 2972 |
| LIN37//PSENEN | 2973 |
| C19orf55 | 2974 |
| TBCB//POLR2I | 2975 |
| ZNF382 | 2976 |
| ZNF568 | 2977 |
| ZNF420 | 2978 |
| ZNF383 | 2979 |
| CCDC97 | 2980 |
| ZNF574 | 2981 |
| CD177 | 2982 |
| ZNF230//ZNF222 | 2983 |
| VASP | 2984 |
| GRWD1 | 2985 |
| FLT3LG | 2986 |
| ZNF175 | 2987 |
| NCRNA00085 | |
| PPP2R1A | |
| ZNF808//ZNF578//ZNF611 | 2988 |
| LENG8 | 2989 |
| FCAR | 2990 |
| RPL28 | 2991 |
| U2AF2 | 2992 |
| LOC100288114//MGC9913 | |
| ZFP28 | 2993 |
| ZNF460 | 2994 |
| ZNF549 | 2995 |
| ZNF211 | 2996 |
| ZNF587//ZNF417 | 2997 |
| ZNF274 | 2998 |
| ZNF544 | 2999 |
| ZNF8 | 3000 |
| TRIM28 | 3001 |
| C19orf6 | 3002 |
| C19orf34 | 3003 |
| GNG7 | 3004 |
| AES | 3005 |
| EEF2//SNORD37 | 3006 |
| PLIN5//LRG1 | 3007 |
| PLIN3 | 3008 |
| PTPRS | 3009 |
| SAFB2//SAFB | 3010 |
| RANBP3 | 3011 |
| GTF2F1//LOC100130856 | 3012 |
| XAB2 | 3013 |
| ELAVL1 | 3014 |
| ADAMTS10 | 3015 |
| FBXL12 | 3016 |
| DNMT1 | 3017 |
| TYK2 | 3018 |
| KEAP1 | 3019 |
| KRI1 | 3020 |
| TMEM205//hCG_29977 | 3021 |
| ZNF563 | 3022 |
| MAN2B1//MORG1 | 3023 |
| C19orf56 | 3024 |
| DHPS | 3025 |
| TNPO2//SNORD41 | 3026 |
| LPHN1 | 3027 |
| NDUFB7 | 3028 |
| AKAP8 | 3029 |
| AKAP8L | 3030 |
| CHERP//C19orf44//CALR3 | 3031 |
| INSL3//JAK3 | 3032 |
| IL12RB1 | 3033 |
| UPK1A | 3034 |
| TYROBP | 3035 |
| ZNF529 | 3036 |
| ZNF461 | 3037 |
| ZNF607 | 3038 |
| YIF1B | 3039 |
| PRR13 | 3040 |
| CEACAM4 | 3041 |
| PLAUR | 3042 |
| TRAPPC6A | 3043 |
| ERCC1//CD3EAP | 3044 |
| RTN2 | 3045 |
| SYMPK | 3046 |
| PGLYRP1 | 3047 |
| NOSIP | 3048 |
| PNKP | 3049 |
| NKG7 | 3050 |
| FPR1 | 3051 |
| ZNF28 | 3052 |
| OSCAR | 3053 |
| MBOAT7 | 3054 |
| LILRA5 | 3055 |
| LILRA4 | 3056 |
| ZNF550//ZNF549 | 3057 |
| ZNF416 | 3058 |
| ZNF256 | 3059 |
| ZNF329 | 3060 |
| FAM110A | 3061 |
| ITPA | 3062 |
| CDC25B | 3063 |
| CDS2 | 3064 |
| CRLS1 | 3065 |
| CSRP2BP | 3066 |
| SEC23B | 3067 |
| SLC24A3 | 3068 |
| HCK | 3069 |
| ASXL1 | 3070 |
| ACSS2 | 3071 |
| C20orf4 | 3072 |
| TGIF2 | 3073 |
| C20orf24//SLA2 | 3074 |
| RPN2//EEF1A2 | 3075 |
| CTNNBL1 | 3076 |
| ACTR5 | 3077 |
| PPP1R16B | 3078 |
| DHX35 | 3079 |
| PLCG1 | 3080 |
| MYBL2 | 3081 |
| SYS1//SYS1-DBNDD2//DBNDD2 | 3082 |
| DNTTIP1 | 3083 |
| CTSA | 3084 |

TABLE 2-continued

| HGNC§ Gene Name | SEQ ID NO |
|---|---|
| MMP9//LOC100128028 | 3085 |
| DDX27 | 3086 |
| SLC9A8 | 3087 |
| RNF114 | 3088 |
| PTPN1 | 3089 |
| TSHZ2 | 3090 |
| PFDN4 | 3091 |
| CSTF1 | 3092 |
| CASS4 | 3093 |
| GNAS | 3094 |
| C20orf177 | 3095 |
| CDH26 | 3096 |
| C20orf197 LOC284757 | 3097 |
| ARFGAP1 | 3098 |
| PRPF6 | 3099 |
| NSFL1C | 3100 |
| SIRPD | 3101 |
| SIRPG//SIRPA | 3102 |
| RNF24 | 3103 |
| RASSF2 | 3104 |
| TMX4 | 3105 |
| JAG1 | 3106 |
| C20orf74 | 3107 |
| C20orf3 | 3108 |
| C20orf112 | 3109 |
| CDK5RAP1 | 3110 |
| AHCY | 3111 |
| GGT7 | 3112 |
| EDEM2 | 3113 |
| RBM39//LOC643167 | 3114 |
| BLCAP | 3115 |
| SERINC3//TTPAL | 3116 |
| ZNF335 | 3117 |
| ELMO2 | 3118 |
| B4GALT5 | 3119 |
| DPM1 | 3120 |
| ZFP64 | 3121 |
| ZNF217 | 3122 |
| CTSZ | 3123 |
| SYCP2 | 3124 |
| PSMA7 | 3125 |
| DIDO1 | 3126 |
| YTHDF1 | 3127 |
| CHODL | 3128 |
| BACH1 | 3129 |
| C21orf41//BACH1 | 3130 |
| IL10RB | 3131 |
| IFNAR1 | 3132 |
| IFNGR2 | 3133 |
| SON | 3134 |
| MORC3//DOPEY2 | 3135 |
| DYRK1A | 3136 |
| KCNJ15 | 3137 |
| ETS2 | 3138 |
| RRP1B | 3139 |
| PFKL | 3140 |
| TRPM2 | 3141 |
| ADARB1 | 3142 |
| SAMSN1//LOC388813 | 3143 |
| N6AMT1 | 3144 |
| SYNJ1 | 3145 |
| TMEM50B | 3146 |
| KCNE1 | 3147 |
| PRDM15 | 3148 |
| C2CD2 | 3149 |
| WDR4 | 3150 |
| U2AF1 | 3151 |
| CSTB | 3152 |
| UBE2G2//SUMO3 | 3153 |
| PTTG1IP | 3154 |
| POFUT2 | 3155 |
| MCM3AP | 3156 |
| IL17RA//CECR7 | 3157 |
| C22orf37 | 3158 |
| LZTR1 | 3159 |
| PPIL2//YPEL1 | 3160 |
| CYTSA | 3161 |
| SNRPD3//C22orf13 | 3162 |
| NF2 | 3163 |
| LIMK2 | 3164 |
| SLC5A1 | 3165 |
| MCM5 | 3166 |
| NCF4 | 3167 |
| GGA1 | 3168 |
| SH3BP1//PDXP | 3169 |
| POLR2F//LOC100131530 | 3170 |
| APOBEC3A//APOBEC3B | 3171 |
| APOBEC3D | 3172 |
| ATF4 | 3173 |
| CACNA1I | 3174 |
| ZC3H7B | 3175 |
| CCDC134 | 3176 |
| TSPO | 3177 |
| NUP50 | 3178 |
| TBC1D22A//LOC100289878 | 3179 |
| RP3-402G11.5 | 3180 |
| SAPS2 | 3181 |
| NCAPH2 | 3182 |
| BID | 3183 |
| SLC25A1 | 3184 |
| KLHL22//KRT18 | 3185 |
| PI4KA//PI4KAP1// PI4KAP2//LOC100293141 | 3186 |
| MAPK1 | 3187 |
| ZNF70 | 3188 |
| TPST2 | 3189 |
| SF3A1//CCDC157 | 3190 |
| PES1 | 3191 |
| PIK3IP1 | 3192 |
| PATZ1 | 3193 |
| C22orf30 | 3194 |
| IL2RB | 3195 |
| CSNK1E//LOC400927 | 3196 |
| UNC84B | 3197 |
| CBX7//LOC100128400 | 3198 |
| RPS19BP1 | 3199 |
| MKL1//KIAA1659 | 3200 |
| RANGAP1 | 3201 |
| TCF20 | 3202 |
| LDOC1L | 3203 |
| UNQ6126 | 3204 |
| TUBGCP6 | 3205 |
| SBF1//SBF1P1 | 3206 |
| MSL3 | 3207 |
| MOSPD2 | 3208 |
| BMX//HNRPDL | 3209 |
| PDHA1 | 3210 |
| YY2 | 3211 |
| PDK3 | 3212 |
| GK//GK3P//FTL//LOC652904 | 3213 |
| CXorf59 | 3214 |
| ATP6AP2 | 3215 |
| USP9X//USP9Y | 3216 |
| RP2 | 3217 |
| USP11 | 3218 |
| RBM3 | 3219 |
| FTSJ1 | 3220 |
| WAS | 3221 |
| PLP2 | 3222 |
| TSPYL2//GPR173 | 3223 |
| MAGED2 | 3224 |
| UBQLN2 | 3225 |
| NLGN3 | 3226 |
| ACRC | 3227 |
| UPRT | 3228 |
| CXorf26 | 3229 |
| ATP7A | 3230 |
| DIAPH2 | 3231 |
| CSTF2//RAD21 | 3232 |
| ARMCX3 | 3233 |
| ARMCX5 | 3234 |
| GPRASP1 | 3235 |
| TMEM31 | 3236 |

TABLE 2-continued

| HGNC§ Gene Name | SEQ ID NO |
|---|---|
| TBC1D8B | 3237 |
| MID2 | 3238 |
| DOCK11 | 3239 |
| LONRF3 | 3240 |
| UBE2A | 3241 |
| SH2D1A | 3242 |
| OCRL | 3243 |
| SLC25A14 | 3244 |
| HPRT1 | 3245 |
| CD40LG | 3246 |
| AFF2 | 3247 |
| SSR4//IDH3G | 3248 |
| FAM50A | 3249 |
| DKC1//SNORA36A//SNORA56 | 3250 |
| ARSD | 3251 |
| KAL1 | 3252 |
| CTPS2 | 3253 |
| RPS6KA3 | 3254 |
| BCOR | 3255 |
| MAOB//NAT13 | 3256 |
| ZNF41 | 3257 |
| OTUD5 | 3258 |
| KCND1 | 3259 |
| ZMYM3 | 3260 |
| MAGT1 | 3261 |
| BRWD3 | 3262 |
| TRMT2B | 3263 |
| GLA | 3264 |
| MORF4L2 | 3265 |
| PSMD10 | 3266 |
| ACSL4 | 3267 |
| LAMP2 | 3268 |
| CUL4B | 3269 |
| ODZ1 | 3270 |
| ELF4 | 3271 |
| RAP2C | 3272 |
| FAM127B//FAM127C//FAM127A | 3273 |
| TMEM185A | 3274 |
| ARD1A | 3275 |
| IRAK1 | 3276 |
| DNASE1L1//RPL10 | 3277 |
| SH3KBP1 | 3278 |
| Mitochondrial | N/A |
| Mitochondrial | N/A |
| CCNL2 | 3279 |
| INPP5B | 3280 |
| TLR5 | 3281 |
| ADRB3//GOT1L1 | 3282 |
| NOC2L//SAMD11//LOC401010 | 3283 |
| SHFM1 | 3284 |

§ HUGO Gene Nomenclature Committee
¶ Synonymous with SPNS1//NPIPL2//LOC728741//LOC730153//NPIPL3//SPIN1//LOC728888//LOC100289169//LOC728734//LOC729602//LOC100288442//LOC100288332
*Synonymous with SNURF//IPW//SNORD116-16//SNORD116-18//SNORD116-21//SNORD116-22//SNORD116-17//SNORD116-19//PAR5//PAR-SN//SNORD116-2//SNORD116-25//SNORD116-26//SNORD107//SNORD115-12//SNORD115-5//SNORD115-6//SNORD115-9//SNORD116-11//SNORD116-12//SNORD116-13//SNORD116-28//SNORD116-4//SNORD64//PAR1//SNORD109A//SNORD109B//SNORD116-6//SNORD116-3//SNORD116-9//SNORD115-13//SNORD115-1//SNORD115-14//SNORD115-15//SNORD115-21//SNORD115-10//SNORD115-7//SNORD115-16//SNORD115-40//SNORD115-42//SNORD115-11//SNORD115-29//SNORD115-34//SNORD115-36//SNORD115-4//SNORD115-43//HBII-52-24//SNORD116-5//SNORD115-7//SNORD115-26//SNORD115-30//SNORD116-15//SNORD116-8//SNORD115-2//SNORD115-39//SNORD116-14//SNORD116-20//SNORD115-8//SNORD115-3//SNORD115-38//SNORD115-41//SNORD115-22//SNORD115-44//SNORD116-1//SNORD115-17//SNORD115-18//SNORD115-19//SNORD115-20//SNORD116@

SEQUENCE LISTING (3284 sequences)

SEQ ID NO: 1 - DNA, 255 bp, Homo sapiens
agaacatcgctcggtgccagacaggcaggacgcagcgggctggcctgcggggctcactgctgccccccggggccgagcacgaaagggagagttggagggcgcttcctcgccgggtgttgcggtgtgagcggggactggtgagtgtgtgctgtcttcagagagagaagagcagttttcaggaatctatctaccgccggggagccagaagatggaggaagctgtaccgtgccaacggccacctcttccaagccaagc

SEQ ID NO: 2 - DNA, 255 bp, Homo sapiens
cggggcggcggcgggggccgggggggcccgggcgcgcgggagcgggagcggccgggggagccggagcgcaccatggaggcggcggcaggcggccgcggctgtttccagccgcacccggggctgcagaagacgctggagcagttccacctgagctccatgagctcgctgggcggcccggccgctttctcggcgcgctgggcgcaggaggcctacaagaaggagagcgccaaggaggcgggcgcggccgcggtgccg

SEQ ID NO: 3 - DNA, 255 bp, Homo sapiens
agcccttggccccgccctcgcgccatcttgggggccctggaggcggcgccgcggaggacggagcggaagtgctcgctgcagcttcccggagccggagcgcagcgcctgcggccgcccgtgccccgccgtcctccttcccgcggccgtgagggagaccgcggctcggccgtagcggagctgcgagttacagaatgtctgaaggggacagtgtgggagaatccgtccatgggaaaccttcggtggtgtacagatttt

SEQ ID NO: 4 - DNA, 255 bp, Homo sapiens
gaagttaggaagcatccggcagctgccttctatttaagcaactggcctccttagaggccactccttggccatgccaggcgcgggcatctggccagcatgctgctctgcacggctcgcctggtcggcctgcagcttctcatttcctgctgctgggcctttgcctgccatagcacggagtcttctcctgacttcaccctccccggagattacctcctggcaggcctgttccctctccattctggctgtctgcaggtg

SEQ ID NO: 5 - DNA, 255 bp, Homo sapiens
agtgacgtctttgccccgcgccgcgccgtcccacccatctccctggcctccggtcccaacttcgcttctctgctgaccctctctcgtcgccgctgccgccgccgcagctgccaaaatgtctacaggtccaactgctgccactggcagtaatcgaagacttcagcagacacaaaatcaagtagatgaggtggtggacataatgcgagttaacgtggacaaggttctggaaagagaccagaagctctctgagttaga

SEQ ID NO: 6 - DNA, 255 bp, Homo sapiens
ctgcgctggggttggagtggccgcaacgggcggggcggggcggggccgggcaagtttgttccccgagttcggagcctaggagccccccgcggctgcggcgcaggtgccctcggcctgagtcgggatggagctgcctgctgtgaacctgaaggtgattctcctaggtcactggctgctgacaacctgcttctggagacatttctctgccaaaccaagactggaaaccattgagctcacctgtgcactttgcaaact

SEQ ID NO: 7 - DNA, 255 bp, Homo sapiens
aggagcggcggggaggaaacgccgcgcagcgccgggctggggcgggcggcccgggacaccgacagatttttctgtgaccatgaaagagagaaataaagaatgatccatgatttctaaacaccttttcctgaggatatagtcatgttggaaggccttgtagcctgggttctcaatacctatttgggaaaatatgtcaataacctgaacactgaccagctctcagttgcacttctcaaaggtgctgttgaattagaa

SEQ ID NO: 8 - DNA, 255 bp, Homo sapiens
aattattaatcagattcttgacattcctcagccccaggttggctggagaagcatgttccccagaggagcagaggcccaggactggcatttggatatgcagctgaccggcaaggtggtgctgtcagccgctgccctgctcctggtgactgtggcctacaggctgtacaagtcgaggcctgccccagcccagcggtggggtgggaatggccaggcagaagccaaggaggaagcagagggctcagggcagcctgctgt

SEQ ID NO: 9 - DNA, 255 bp, Homo sapiens
tcgcgagactttcaggggtcggagcgcgggggccggccgagaggaaagctggaggcgcgggtggggaacatgtctgagtcggagctcggcaggaagtgggaccggtgtctggcggatgcggtcgtgaagataggtactggttttggattaggaattgttttctcacttaccttctttaaaagaagaatgtggccattagccttcggttctggcatgggattaggaatggcttattccaactgtcagcatgatttc

SEQ ID NO: 10 - DNA, 255 bp, Homo sapiens
ggaggcagctgggctgcagctcagaaagcaacgctcatctgcaagttgggacagcagaggcccttcattcctccccagggctcccacaccttgggagggactgtgaagagtgactcttgtccagtggttttcaaactgggttcctctaagccctggggtattagtgccccagggacccctgaagtttgttactgctgctctgaagcttttcagcatttcttgaaataatgaattccagtaacactgatagctctt

SEQ ID NO: 11 - DNA, 255 bp, Homo sapiens
cctagtcccagcccagggggccgctctcgccggcgtcgagggcgtggcggcgaggctgctgctgcaggcggctcccggctctgccttcggccccgcccgccgcccaccaggctcccagaggccccgcagctcgcgccgtccggctccccgcagccccgtcgggcagcccgggcccgtccgctgccctcccggctcccgtcctgcggcggcggggcgtgcaggtgaggccccacggcgcccggcctctccagcagt

SEQ ID NO: 12 - DNA, 255 bp, Homo sapiens
ggagctggcgctgggaggggaggagcgcgcagcccgcgcgccgcagggccgggcggaaagtttttcctgacggagttttggctgcggcagcggcggcggcggccggagcgggccatggacgcgctcaagtcggcggggcgggcgctgatccggagccccagcttggccaagcagagctgggggggcggtggccggcaccgcaagctgcctgagaactggacagacacgcgggagacgctgctggaggggatgctg

SEQ ID NO: 13 - DNA, 255 bp, Homo sapiens
aaggcgcgggccccggcgcggcggggagggctcggccggaggggaggctgcggcgcgcggccggtcgctgcgggcccgggccccaagccgtgccgctccgctcgcccgggccccgccgaggccgctgcgcccccgcctcctcgcgggaggactcgctccaaactccctgaacttcggggacagtcccccgaagcggcgaaactctcagggttggcaaccctgcccagggacccccatcccgggcggcgctccgga

SEQ ID NO: 14 - DNA, 255 bp, Homo sapiens
tggagagagcggctctcgtggctggggagttggatgcaccaaacctgtgtgcggctggagagggaggcttctgccagaccctctcccgggcctgtcctgccacccaggcccctccccagtctcacactgagctccagatcagggaagggccgaaaaggacgatcagggcagccgcagaaggggcgccctgcgtgggacgggtccgttgcgcgcctggtaaccgagggggaagggaaggggcctctggcgtgcggg

SEQ ID NO: 15 - DNA, 255 bp, Homo sapiens
gcagcgcccaaagatgacgtgttctgccagcgccacgtcatgaggaagtgccggcccactgaagccgtggggacgcgcccagcggagctaatcagattacctggctggtgtttgcttgttctggagtgatcttctgactggaaaagaactatgtcatggatcaaggaaggagagctgtcactttgggagcggttctgtgccaacatcataaaggcaggcccaatgccgaaacacattgcattcataatggacggg

SEQ ID NO: 16 - DNA, 255 bp, Homo sapiens
agttgccgcggatcgtgctgagccccgcgagccgaggcagcgcagcctagggagggggctgccccggccccctcctgcagtcccggcccctagaggctcggccttcctcgcaggaaggcgaagtccccggtgccaggtccggggaccagcagccgagaacgcccgggtcccggagccaacaggttcttggtgaagcacttggcacgcatcggagctcattactcctcatcgtggtcctgtaaggaagtttgaggc

SEQ ID NO: 17 - DNA, 255 bp, Homo sapiens
aaatgaactccctccagcttagctttcacccggtggtgttcccgggaggagagggcggagggcggagggaacttgcaccgaagcatcactcgagaccccaaacctccaggcctgaggcccagccagcgcccaatggatgacaaaaagaagaaacggagtcccaagccctgcctggcccagccagcccaggccccaggcacactacggagggtccctgtgcctaccagccacagcggctccttggccctaggactt

SEQ ID NO: 18 - DNA, 255 bp, Homo sapiens
aagtcagggtgggacgtgggcgcggggagacaggtggtggctacgacggcgaagggagctgagactgtccaggcagccaggttaggccaggaggaccatgtgaatggggccagagggctcccgggctgggcagggaccatgggctgtggctgcagctcacacccggaagatgactggatggaaaacatcgatgtgtgtgagaactgccattatcccatagtcccactggatggcaagggcacgctgctcatccga

SEQ ID NO: 19 - DNA, 255 bp, Homo sapiens
gccggagccccagcccggccctgctcgggccgccgggcgcggggctgcggccgcgtcccggaggcgccgccagcacagccaggtgctgttgggaacacagaggaagtgactggctgggggttcagggaaagctccgtagaagagggaacacttgagctgggtcttgaaggatgagtagaagttcaccaagtgggaaaggacactctaggatggccgagcctcgatttaacaacccctacttctggccccctcctc

SEQ ID NO: 20 - DNA, 255 bp, Homo sapiens
ggagacgctgggcgcgctgtggggcgggggcgaggttcgggctggttgttccgttgcgagctgcagctgcgatctctgtggtaggcccagaagtgtatgctgacttgtaaagtgaagaagccagtggtgctgcgggtgttcttttggggtagtgtctgggatccagtacgagttgaatcattgttcaaataaggtgtaattgaaaagtgatcctctcttcagagatgtcaaaaacaaacaaatccaagtctggat

SEQ ID NO: 21 - DNA, 255 bp, Homo sapiens
agtggggaagaggacgggtcgagtgctggcttccggcggaaaagcgcgcgagcaagatggccaccaccaagcgcgtcttgtacgtgggtggactggcagaggaagtggacgacaaagttcttcatgctgcgttcattccttttggagacatcacagatattcagattcctctggattatgaaacagaaaagcaccgaggatttgcttttgttgaatttgagttggcagaggatgctgcagcagctatcgacaaca

SEQ ID NO: 22 - DNA, 255 bp, Homo sapiens
tctccggggcgtggcgaagaggggcggagtcacgagcggggcggtgagacttcctgcccagtcgcgggccagcctagcgcttcagccggcggctcatttccggtgggggcgccgcgcccagtgagggcccggaagtgggtcgcgcggagattgctgggcggttcttgccggaagcggagagcggctgatcgcagtccggaggtggtccattatggctgacatgcaaaatctggtagaaagattggagagggcagt

SEQ ID NO: 23 - DNA, 255 bp, Homo sapiens
tccctcgcccggaggcagagatgcgctggcgcatcaccgccaggagcccacagtgaaagaccatcggatggaaggcgacgcccagaactccaggagaccgctgtgggaggacgcgaggccaggtgacgaataggccaggcgtgagttcccaaacagcctcctccccttcaagagagtaagcttgggccacaggctgggacggaagcagaggggcagacacgccaccacccgcccggcctcgaacctacggcggca

SEQ ID NO: 24 - DNA, 255 bp, Homo sapiens
tcctgctgggtgccgaggtagcgaggtcaggggtcaagagtggaacaccctcactggcccgggccggcgcgggagggctgtgtgatggcctcggagcgcccggagccggaggtggaagaagctgggcaggtgttcctgttaatgaaaaaggattatcgaatctcccgaaatgttcgcctggcttggttcctcagtcatctgcaccaaactgtgcaggccacaccccaggagatgctgcttcagtctgaacaggaa

SEQ ID NO: 25 - DNA, 255 bp, Homo sapiens
tccgggttttgcggcggagcgggcgggctgcgcgtgcggcggcttcaactgtcgcggtaggcagcagcaggctgaagggatcatggtgcagtacgagctgtgggccgcgctgcctggcgcctccggggtcgccctggcctgctgcttcgtggcggcggccgtggccctgcgctggtccgggcgccggacggcgcggggcgcggtggtccgggcgcgacagaggcagcgagcgggcctggagaacatggacagggc

SEQ ID NO: 26 - DNA, 255 bp, Homo sapiens
taggcggatgccgccatgcagcactacggggtgaacggctactcactgcacgccatgaactcactcagcgccatgtacaacctgcaccagcaggcagcccagcaggcccagcatgcccccgactaccggccttcagtgcatgcgcttacattggctgagcgcctggctgacatcatcttggaggcccgttatggttcccagcaccgcaaacaacgtcgcagccgcacagcgttcacggctcagcagctcgaggcc

SEQ ID NO: 27 - DNA, 255 bp, Homo sapiens
aagatgcatgggtccagagtataaaggaacccaggagcagctgaaggcaggtcagatgaaggctaggtggctggaactgcaaccatggtgcccagcttcctctccctgagcttctcctccttgggcctgtgggcttctgggctgatcttggtcttaggctttctcaagctcatccacctgctgctgcggaggcagacgttggctaaggctatggacaaattcccagggcctcccacccactggctttttggacat

SEQ ID NO: 28 - DNA, 255 bp, Homo sapiens
agtgctagtggcggcaggtgcaggtggccgcgcggcatcctggggcttgcagtctcccgagcgttctgttgtgtccctgcctacaattttagggaacctaataaaagggtggtcggtatgtttttatttgggtgtgtacttttgttaggtcgctttttcgctatgcattaagtacggactttaggactcaactagtaccaggaagaaaaagaccggacattttcacctgtttgttatacagcgaaggggaaaaat

SEQ ID NO: 29 - DNA, 255 bp, Homo sapiens
cgcgcacgcgcgcctccccggcccagccttgctcccgcccccgccggtcccgcggtcccacggcgcctggttgcccccagccccctccctcctcccaccttcactgtgtcccacccttcctagctttgtgcccggggtgctgagcccttccccgtcagccgggccgcgggaggagggagccgtcaccgaggagctgccgctcgctgccccgggcaggggcacagttgcaaccaaggcaatgtcttactacctcag

SEQ ID NO: 30 - DNA, 255 bp, Homo sapiens
actggcctgggctggggaagcctaggtaagctgaggggcagctctgggaaagtcctaggggtgggggcagtctccacagcctcccacaagggagttaccaccttcccgcacttctgggtacaagtctcctgctctggctgtattccacagttagaacttcatatctttggcttagagctgaattttctgttaccatgtggatgctccaggtgaagtgcggagcttgttaacagacgtgcatgcctggcctgtgga

SEQ ID NO: 31 - DNA, 255 bp, Homo sapiens
ggcctggctcggtccctgcgcaccgggtgcgggcggcggagagggcgcggctggtgagccctgggagggcccaggagccagacctcggttttgcgggctggggagcagggctcgggggcagcggccaggcccctccgcccctaacacccgcgcctcctgcagacccgagggtcgccgctggtagggtcgctcagccctgccgtccttcaccaccacaccttcacctgcgcccagctccctgcgcgcctggacagc

SEQ ID NO: 32 - DNA, 255 bp, Homo sapiens
aaccgggcggaggcgcaccccagggcgcatgcgtgctgtgcggcgcggtctcagggaaggtggggctatggcagctgctagggaccctccggaagtatcgctgcgagaagccacccagcgaaaattgcggaggttttccgagctaagaggcaaacttgtagcacgtggagaattctgggacatagttgcaataacagcggctgatgaaaaacaggaacttgcttacaaccaacagctgtcagaaaagctgaaaag

SEQ ID NO: 33 - DNA, 255 bp, Homo sapiens
cgcaagtccccccaccgttcagcgcaaccgggccctcccagccccgccgccgtccccctcccccgccctggctctctttccgcgctgcggtcagcctcggcgtcccacagagagggccagaggtggaaacgcagaaaaccaaaccaggactatcagagattgcccggagaggggatgcgacccctccccaggtcgcagcgacggcgcacgcaagggtcacggagcatgcgttggctacccggcgccggggaccgc

SEQ ID NO: 34 - DNA, 255 bp, Homo sapiens
gacgcgcagcaggccccgcccacccaggcggtaggaacccactccggcccgctagacctgctgctatgtcccggccgcagcttcgacgctggcgcctcgtctctagcccgccgagcggcgtcccgggtctagcgctgctggcgctgctggcgctgctggcgctgcggctcgcggccgggaccgactgcccatgcccggagcctgagctctgccgcccgattcgccaccatccagatttcgaggtctttgtgtttg

SEQ ID NO: 35 - DNA, 255 bp, Homo sapiens
gggggaggcgcgcgtcgagaggcgacggcgggctggcctggcgcgctgcggcgctcgctcacccgctcccgaggaagggcagtgggccccgccgccgcctcccaatggcgaggctgcgggattgcctgccccgcctgatgctcacgctccggtccctgctcttctggtccctggtctactgctactgcgggctctgcgcctccatccacctgctcaaacttttgtggagcctcggcaaggggccggcgcagacct

SEQ ID NO: 36 - DNA, 255 bp, Homo sapiens
ccggcgtcttagcccgctcttctggccccgccccgcgctacgcgtagggaggcggggcctcggggcgagacgccggagcgtgtccccgtccggcagactactctcccccatggcggacttcgctgggccgtcttctgccggccgcaaggccggggctccccgctgctctcgaaaagccgcaggtactaaacagacaagtactttgaaacaagaagatgcttctaaaaggaaagctgaactagaagcagctgtgag

SEQ ID NO: 37 - DNA, 255 bp, Homo sapiens
agggggcggggaggcggggggaggcggggagcccggccgccagcgctcgggtccgcctctgactgcagcgcggcggggcgatgtgtgattaccatggcgaggagtctctgtccgggggcctggctaaggaaaccctattacctccaggctcgcttctcatatgtgcggatgaaatatcttttcttttcctggttagtggtttttgttggaagctggattatatatgtgcagtattctacctatacagaattatgc

SEQ ID NO: 38 - DNA, 255 bp, Homo sapiens
gcgcatgcgcactgactgcggaactgggcgaacccgggggttcgtttctgctgactccagtgtcccgagaggcgccgcttcttccgctttctcgtcaggctcctgcgccccaggcatgaaccaaggtttctgaactactgggcgggagccaacgtctcttctttctcccgctctggcggaggctttgtcgctgcgggctgggccccagggtgtcccccatggcggggccgcgggtggaggtcgatggcagcatca

SEQ ID NO: 39 - DNA, 255 bp, Homo sapiens
gcggcccgggccggaagtaagcgaattcccgggtgtgtgtctgtgtctgtctgtgtctcgcagcggcgcgcggccccggacaagcgctggggattcccgtttgaggcgtcactactgtcactgccatcaccccacggagccacttctagaggggagtagacccggcccttcgccgggcagagaagatgttgcccctgtccatcaaagacgatgaatacaaaccacccaagttcaatttgttcggcaagatctcgg

SEQ ID NO: 40 - DNA, 255 bp, Homo sapiens
ggtttccagaatccttagcgcgaggcggaaaaaatatttctcccagcttgtgttgatgccgcgattttgactgagacttcttcccacgatttctgtttttgcttctccaaggaaaatggcagctcccgagcagccgcttgcgatatcaaggggatgcacgagctcctcctcgctttccccgcctcggggcgaccgaacccttctggtcaggcacctgccggctgagcttactgctgaggagaaagaggacttgct

SEQ ID NO: 41 - DNA, 255 bp, Homo sapiens
aggagccggaggaggagccgccgccgccgttgacccggccgccggccgggagctgggagagatgcggagcccggccaccggcgtccccctcccaacgccgccgccgccgctgctgctgctgttgctgctgctgctgccgccgccactattgggagaccaagtggggccctgtcgttccttggggtccaggggacgaggctcttcgggggcctgcgcccccatgggctggctctgtccatcctcagcgtcgaacct

SEQ ID NO: 42 - DNA, 255 bp, Homo sapiens
gctttgcgtgcgtgtttgcgtacagcggaggtggcggcgcgggcaggtcggagctcggagctgctgcttctggttctcttgtggccgccgtcgctgtccggctgccttgggctgccgaacagacaaggcgtgggccacagcacctcagaagccgacgcagctcgacgcaggggccggcaggagggtgggcgatcgcgtgtcggagggcgccgcgcgggcaggcgggcgggcgccagagggggaaagaggcggggg

SEQ ID NO: 43 - DNA, 255 bp, Homo sapiens
aatcgcgaaagtgtcgtgaacgtgctgccgccgatcagtcacccagtcggctggagtcggaggcgatatttctaggggtgtacttgttggggtcagggtaagcaccagccacaaaaacctacaaaagaagggaaattactgtctttaaatattaaaaaaaaacaagatccatgagtgggcatcgatcaacaaggaaaagatgtggagattctcacccggagtccccagtgggcttcgggcatatgagtactacag

SEQ ID NO: 44 - DNA, 255 bp, Homo sapiens
aaagcttcatgaaacctcctcgtctgtgcacgaacaggtggccgactctggagcccaggctgttgctttccagtctggtggtgaatcctccatagtctgaagcctttgtgataaccacagaatcagaacatataaaaagctctgcgggactggtgctgactgcaaccatgacaaagcttattctcctcacaggtcttgtccttatactgaatttgcagctcggctctgcctaccagctgacatgctacttcacca

SEQ ID NO: 45 - DNA, 255 bp, Homo sapiens
ctgagtccccaggcgctagctgactggggtggttgggaccgttagctcggcaggctggcaggctccggggcgctactccattggcggccgggatggagactatgcgagcgcagcggctgcagcctggtgtgggcaccagcgggaggggcactctccgagcgctgcggcccggagtgactggggccgcggccgccaccgccacaccccctgcgggccccccgcctgccccgccgcctcccgcaccgcccccgccgc

SEQ ID NO: 46 - DNA, 255 bp, Homo sapiens
ttctaatgcttttaaggttccttttcagcccttcctcctcgtaatccacaaatactgagaccaaggcattttttgggtcagtcctaatttcaagcattctatcctgccctccccaaatgaactcacacttattagaccatatgttcctatattagttcaggaagggggaaaaaatgttcatcacacttgtatataagagatcatagaaaaacagtttactaacctgtgaaaataccattcattctctgtttacct

SEQ ID NO: 47 - DNA, 255 bp, Homo sapiens
aatttccgcttccggtagtgagaacccttccggtgggctaggtactgagcgcgcgaggtgaggagttgtgcagggtttggggaaaggaaggctggcttggcgagagggcaggtttgcgggctttcgcccccttttccaaagaccaacaaagagtccttccccaactcccaactcaaccccttttggaactatgtgtggtggttgggaccctgtggcgcatccttgtcgctcgtgtccttctcatgcccggcgacg

SEQ ID NO: 48 - DNA, 255 bp, Homo sapiens
ggccaagccaaagggctctcacactaagtgaagcttctccattctgtaagctttccgggaacatccaaggcaagactggcacccagcacagcagtgactgaccacataccccactctccaggacccatggagtccttcagctcaaagagcctggcactgcaagcagagaagaagctactgagtaagatggcgggtcgctctgtggctcatctcttcatagatgagacaagcagtgaggtgctagatgagctctac

SEQ ID NO: 49 - DNA, 255 bp, Homo sapiens
agaaggctttggcttctgatagtcatggactcactaggctgctgaggaagatcaataatacctactggaatcagtcatgagaagtcaagcatggaaattgtgaattgtgtgtgtggccagaccagtacctccaagtgttcagaagatgtgtgaccagacaaaacacagtaaatgctgcccagcaaaaggcaatcaatgctgcccaccacagcagaaccagtgctgccagtcaaaaggcaatcaatgctgcccacc

SEQ ID NO: 50 - DNA, 255 bp, Homo sapiens
atatgtcttggaatccttgacccagttccgaggactggagaggggatagaaccttgtgtccaaggaggtccttcaggagacctgggatgagtggtgcttccccaaaacagactcatggacattaaacatcatcagaatggcacaagagggcaaagaagaaaacagcctcataccacggtgcagaggctcctgacctgggggctgccagtctcctgtagctggttcctgtggcgccagccgggcgagtttcctgtc

SEQ ID NO: 51 - DNA, 255 bp, Homo sapiens
cgcggggcggggctccagagccgcaggtctgggctgcagtaggtcccggcaaccgcaggctcgcggcgggcgctgggcgcgggatccgactctagtcgtaatggaggcgggcggctttctggactcgctcatttacggagcatgcgtggtcttcacccttggcatgttctccgccggcctctcggacctcaggcacatgcgaatgacccggagtgtggacaacgtccagttcctgccctttctcaccacggaagt

SEQ ID NO: 52 - DNA, 255 bp, Homo sapiens
agggggatcgcttgaacctgggaggcagaggttgcagtgaacagagatcgcgccactgcaacccagcctgggtgacagagcgagactttgtctcaaaatataaaaagaaaaaaaataagggatcttccaaaaggaaaaggtgaccagtcgagaaatctgggaaaacccaactggttagtgggaaagagtacaacgccggggacacggagggaacgattacatctaagatcagtgagattggaacaggctgagatc

SEQ ID NO: 53 - DNA, 255 bp, Homo sapiens
ttgccattacccacagaataaagaaaggggccctgttattcaacaataggggaaaagacagagacaatgggaaattgtgcttccgatggggtggggactgagaaggaaaggacagacagacagacagacagggggttgtacagaagaggtccggtttcttgaagcagctggaagtcctggatagttcccacctgaaagtctgtttgcaaaggcaatgcgcactcaggcaccagagggcagaggggctcaagttcc

SEQ ID NO: 54 - DNA, 255 bp, Homo sapiens
tgcagctgggagcgcacagacggctgccccgcctgagcgaggcgggcgccgccgcgatgctgcgaggcggacggcgcgggcagcttggctggcacagctgggctgcggggccgggcagcctgctggcttggctgatactggcatctgcgggcgccgcaccctgccccgatgcctgctgcccccacggctcctcgggactgcgatgcacccgggatggggccctggatagcctccaccacctgcccggcgcagaga

SEQ ID NO: 55 - DNA, 255 bp, Homo sapiens
ttccagcagttagtgcaattagggaggttgggaggatgtacacaagagcagggagaaaatctggagccagacagtgagagaggcagaggggaaatgaaaaaccccgtgggaggctgcagcaaagcgaggcagtgtggcttctctgacagggaagtcagcagagggagaggtttgtctgtctgtacagcaagggaagtcagacgagagtgcaagagggtgtggagaggggtactgatatctgaattattagggcag

SEQ ID NO: 56 - DNA, 255 bp, Homo sapiens
gaagctgcagttctgccatcactcaagatggctgcccccatcaagatgaccggggtgtgccggggggaaaggggcagcatgatggtctgagatggtgtagcgtcggaccatgtggaagtttctgaggctggggagccggataatggggggtggggcccgttggggggtaaaggggcaatagcgtcctttcacaggctaacctcggctcttcccagtcctctggactaaaatggggaacacattgggcctggcacc

SEQ ID NO: 57 - DNA, 255 bp, Homo sapiens
aaactcctctgagcaactgaagtttccttattcagttgaagattgctatggtgtaacagaagttgtattttgcttttccccttaatccactttccaccctacgcaacccccctcttttcgcttaagaacatactgtagatttgttagaaatagtagtaccttctttccccaccccaaactgctacctgtttcttccttgtttggactctctgctcctctagaagatttcacagcaatgctggactgcagtgacta

SEQ ID NO: 58 - DNA, 255 bp, Homo sapiens
gggtcggccggcagggggcggggccgggcatggtaacggctcggaagcctaggaggctgggccggagggaggcggaggaaccggtgttcgccgccgccgctgcttcagcttattccttgtggcctctgcgggtcctgcctcagccatgatgatccacggcttccagagcagccaccgggatttctgcttcgggccctggaagctgacggcgtccaagacccacatcatgaagtcggcggatgtggagaaattagc

SEQ ID NO: 59 - DNA, 255 bp, Homo sapiens
gtcaacttagcgagcgcaacaggctgccgctgaggagctggagctggtggggactgggccgcaatggacaagctgaagaaggtgctgagcgggcaggacacggaggaccggagcggcctgtccgaggttgttgaggcatcttcattaagctggagtaccaggataaaaggcttcattgcgtgttttgctataggaattctctgctcactgctgggtactgttctgctgtgggtgcccaggaagggactacacctc

SEQ ID NO: 60 - DNA, 255 bp, Homo sapiens
tttagattcaacagttcacagcggcgggctgctgctgctgcctctccgaagagctcgcggagctccccagaggcggtggtccccgtgcttgtctggatgcggctctgagtctccgtgtgtctttctgcttgttgctgtgtgcgggtgttcggccgcgatcacctttgtgtgtcttctgtctgtttaaacctcaggatggctcgcttcggggaggcggtggtcgccaggccagggtccggcgatggagactcggac

SEQ ID NO: 61 - DNA, 255 bp, Homo sapiens
ccctcctccctccccctcccccccgggtcggagtgtccctgcgccccacgggccagagcagcagcgagagcagctttccccactccctccccctcgcctcattcacccccacccccctgccgagcgaggaggagccggaggagaggaagatggcggcggccgccagcacccgcggtgccgcggggccgctccgaggagcctgagagacccacggaggcttcgcgggaagacgcggcggcggcggcggaggatgag

SEQ ID NO: 62 - DNA, 255 bp, Homo sapiens
gcccagcccacattagcttttgaagggaatatttttatgttcataggaaaaaaagcatagctcctctatataaccaacttcttttagtactactgatagctagtatgttaagtttgatggactaattataatcttttttttatattcctagtatgctggattctatgattggcagatttaacatttatccttctcgtaattcacaaccctaaagttccatttactaataatttataattttgctggaacatgaat

SEQ ID NO: 63 - DNA, 255 bp, Homo sapiens
gcaaacagccggggctccagcgggagaacgataatgcaaagtgctatgttcttggctgttcaacacgactgcagacccatggacaagagcgcaggcagtggccacaagagcgaggagaagcgagaaaagatgaaacggacccttttaaaagattggaagacccgtttgagctacttcttacaaaattcctctactcctgggaagcccaaaaccggcaaaaaaagcaaacagcaagctttcatcaagccttctcct

SEQ ID NO: 64 - DNA, 255 bp, Homo sapiens
atgagtgtatgtactctaagtgtaccagtttcttcactctctcctggcagaagatgcaacacttttagtgattctgggattctgggatgtgttcctattaattctaatacagatgaagaagatgtggtagaggaaaagatggtagcagaaggagtgaataaagaggcaaaacagcctgctaaaaagaaaagaaagaagggtttgcgaattaaggggaaaaggcgtcgaaaaaaattgattcttgccaaaaagttt

SEQ ID NO: 65 - DNA, 255 bp, Homo sapiens
ctccccagcccggccggccctcccgcgggcggcactcgggcaccgggctcgccgggaccagatccgcgagcccgtcagcctgcgccatgggctgcgacggccgcgtgtcggggctgctccgccgcaacctgcagcccacgctcacctactggagcgtcttcttcagcttcggcctgtgcatcgccttcctggggcccacgctgctggacctgcgctgtcagacgcacagctcgctgccccagatctcctgggtct

SEQ ID NO: 66 - DNA, 255 bp, Homo sapiens
ctttgaattcctagctcctgtggtctccagatttcaggcctaagatgaaagcctctagtcttgccttcagccttctctctgctgcgttttatctcctatggactccttccactggactgaagacactcaatttgggaagctgtgtgatcgccacaaaccttcaggaaatacgaaatggattttctgagatacggggcagtgtgcaagccaaagatggaaacattgacatcagaatcttaaggaggactgagtctt

SEQ ID NO: 67 - DNA, 255 bp, Homo sapiens
ggaagcagagctgtgcagctgaggcgccgccgtggagccgccttggagccaccgccccctcgccgcttcgccgctgcgttggggaacctggaccgcggcggcgccgggtttccctcatgatcccgggcgggtggcggcggcggcagaggcggcgggaggatgacctcttaccgggagcggagtgccgacctggcccgtttctacactgtcaccgagccccagcgacacccgaggggctacacagtatataaggtc

SEQ ID NO: 68 - DNA, 255 bp, Homo sapiens
gagctcggcgcggagcccggagcccgcagccgacagtctcctgctcccgtacgctgggcgccagctccggccgtgctgcccggctgcctgagagcgcgcccggccatggagccctcgcacaaagacgccgagacggcggcggcggcggcggcggtggcggcggcggacccccggggggcgtcctcgtccagcggggtggtggtgcaggtccgcgagaagaagggccccctgcgcgccgccatcccctacatgccc

SEQ ID NO: 69 - DNA, 255 bp, Homo sapiens
ccttacccggcgtgccccgcgcccggaggcgctgacgtggccgccgtcagagccgccatcttgtgggagcaaaaccaacgcctggctcggagcagcagcctctgaggtgagggcgaggggcgcgggccggtgtgggccgcagagacgttggagccggcgggggctggggactggcctcggggcgacttgaggtgtccctggccagtgtccttccacctgtccacaagcatggggaacatcttcgccaacctcttc

SEQ ID NO: 70 - DNA, 255 bp, Homo sapiens
ccaccgcgcccgcggccggcccaggcagcactcgcgagcagcggcggccccgccggcggccgagttgggagaatgcggcggcgctcgcggatgctgctctgcttcgccttcctgtgggtgctgggcatcgcctactacatgtactcggggggcggctctgcgctggccgggggcgcgggcggcggcgccggcaggaaggaggactggaatgaaattgaccccattaaaaagaaagaccttcatcacagcaatgga

SEQ ID NO: 71 - DNA, 255 bp, Homo sapiens
ccgcaaggaaaacccagactctggcgacagcagagacgaggatgtgcgtgggggctcggcggctgggccgcgggccgtgtgcggctctgctcctcctgggcctggggctgagcaccgtgacggggctccactgtgtcggggacacctaccccagcaacgaccggtgctgccacgagtgcaggccaggcaacgggatggtgagccgctgcagccgctcccagaacacggtgtgccgtccgtgcgggccgggcttct

SEQ ID NO: 72 - DNA, 255 bp, Homo sapiens
aaatcccccaagttctcatgatccttgcttccctttccagtcacccttggtgccctgtacttcactgtggtcctgaactgaagagctgtgtttttcaggaagacttggccaggccgtgttccgtgtctctggattcaagtcccaggagtcctgaccagagagcaggcatcagtgtttttctgaccgaagttctcatttcctgacaatggaaatggaacaagaaaaaatgaccatgaataaggaattgagtccaga

SEQ ID NO: 73 - DNA, 255 bp, Homo sapiens
aatgagaaacccctacacagggctctatgtcccctcgccctctccagtcaaggccaccacaagccaagggaggtctgggcgtgagaggtgagaccccgtgctccccctgccctgggtggaggaagggggtgccctgccaccctgagaacaatggtgtgtgcagaagagaagggactgaaactctttgaagatgttccaggatttagcacccagggagcggcggagactcagccccaccagcctccggcacggagg

SEQ ID NO: 74 - DNA, 255 bp, Homo sapiens
ccgccgccagcatgccccggcccgcgggccgctccgccgccagccacccccgcggccctcggcggcctgcgctcggcccgggggcgcgggaaccgcagccggagccggaggcgggagcagcgagccggagccccgggcgctcgaatgcaggatgctcgtggtccccagcatccttgagccaccaggagtgagggctgctgctccctgagacctggctccaaggaggatgccacagccgcctgccagctccggtct

SEQ ID NO: 75 - DNA, 255 bp, Homo sapiens
agacgctcgcgagcaaccctccgcgctccggagcctcctcagcctcccgcacaccccgagacgctcgccccgctgggcctcggtccccgcctcctcccccgtccttttcccctctctcgctccccacattgtctctgcctcattttctctcctagttgaggattaaaaaaaaaaaaaaatcaccatcatcctcagggagccccctcgccctcggaaaacaaaaccagacatgatcctgggctcctgcttctgaaa

SEQ ID NO: 76 - DNA, 255 bp, Homo sapiens
atggagaacaaagaggcgggaacccctccacccattccatccagggaggggcggctccagccgacgctgttgctggcgacactgagcgcggcctttggctcagccttccagtacggctacaacctctctgtggtcaacacgccgcacaaggtcttcaagtcattttacaacgaaacctactttgagcgacacgcaacattcatggacgggaagctcatgctgcttctatggtcttgcaccgtctccatgtttcct

SEQ ID NO: 77 - DNA, 255 bp, Homo sapiens
acccgggaaaccggaagccgcctcccacttggttgctcgtacgcggctagtgggtcctcagtggatgtaggctgggcgccgcgatgttcgacgggacaccggcggagagcgacctcggggttaaggggtggggctgacgtcaggagccaagatggcggcggtggtcgccctctccttgaggcgccggttgccggccacaacccttggcggagcctgcctgcaggcctcccgaggagcccagacagctgcagccac

SEQ ID NO: 78 - DNA, 255 bp, Homo sapiens
aagaaacaagctgggcagctctgggagagaggagtgtcagacagctgttgtcaacaggcacctggccagagtgaaaaggaggggcagattccatccaagtcccagcggcgccagctgacactctctgccaatgcccaggtgctgagcgacagtgtcccaccggtccctgtgcccagaatggcctgcaccaagaccctgcaacagtcccagcccatctccgcaggagccaccacaaccaccaccgctgtggcccct

SEQ ID NO: 79 - DNA, 255 bp, Homo sapiens
aatccacctcccaccagggcacttccggcggcgctctccgcgccttatcgccaaagctgcggctctggacgcccagccgcggcgtatcccgatcacttccgggtagtgctccacgggcacgagccgcgattgggctaccgtagatggggtacttccggtgtgcaggtgctgggtccttcggcaggaggaggaagatggagcccagcaccgcggcccgggcttgggccctcttttggttgctgctgcccttgcttg

SEQ ID NO: 80 - DNA, 255 bp, Homo sapiens
ccgcccgcccctcggcgtctagcttcgtccccgccgtgagggcgggacttcctctcgttggctcgccgtttccgacgctgtccggaagtcgagttagtctagttagtatcggcctgttatctccttttgcgcgacacggtctcagctgttccgcctgaggcgagtgacgctggccgccaacgaggtatacgtactgggaccctcgccctcagtctcgtctccggcgcggctacctgccccgttttccctgtgagt

SEQ ID NO: 81 - DNA, 255 bp, Homo sapiens
cttcgtaaagatggccgcggaggcttttggagccaactgggagcgcagtacgcgttttctggagcatgggcagaggagacaggaacaagcgtagcatccgtgagcaccgattggctgaagcgagcaccccgggagctgactggctccgccattcgcgggaaggcgtttgtggtgccagagaaaagtagccagagcggcgcagtggcggccgcgttctgtggttttccgctattcccccagacccgcaccttctcg

SEQ ID NO: 82 - DNA, 255 bp, Homo sapiens
aattacgtcactatcatgcgtcccatttgccaggttataacatggctaccgcagcaacaccccacccaggcttctcactaaatttcccaacctgaccacctcttcggcccactccacctcaggaaaaggaggaacattagcgctggtacagccgccaagacttccggaagctccatcaatcacttagctcccctggtctctcgggtaggcatccgcccaccgcccccatcgtcacttccgtcggccgacagcacc

SEQ ID NO: 83 - DNA, 255 bp, Homo sapiens
gcggcggcgggagctggttccggctgcgcgcgcagcggtggtggtggcggcgcgatcggccgggctgtaaccgtcgtctgtccgggagcggctggagcggcagcggcggccgggcacggcgcgaggtgacgccacagggcagcggcggcagcggaggcagcggcggcagcaggagacgcagcggcggccgcagcagcagcagcaagacggactcgtggagacgcgccgccgccgccgccgccgggccgggccggg

SEQ ID NO: 84 - DNA, 255 bp, Homo sapiens
accggcagctcggattcggctggttccgggttgagaggctgcgctggaccgaagcggtggctgctaagctcgcgggggtaaggggtcgcgctgggccagggtttggggccgggatccggcagctgagcgggccggcacccctcctcttctctgccggtcacagccaatgtacggctcggcctggctgccccctcccccaggattccccatccccagcttctcgccctccccgcaccgcccccaccccgggatttc

SEQ ID NO: 85 - DNA, 255 bp, Homo sapiens
catctgcctgcccttctgccatccgagcgccctgactgcgccacactgcaggccatggagaatgagctgccagtcccacatacatctagcagtgcctgtgccaccagcagtaccagcggggccagtagcagcagtggctgcaacaacagcagcagtggtggaagtggccgccccaccgggccccagatttctgtgtacagtggtattccagaccggcagaccgtgcaggtgatccagcaggccctgcacagacag

SEQ ID NO: 86 - DNA, 255 bp, Homo sapiens
ggacagagcggcccggtcgccggcatggtttctccgtcctgctgcagccggcgggaggcagccagtccaggcgcccgctagcttcggcggcgacccagacggggaaagcggaaggaatgtcgcgtgcaagcaggcagctggtgtggaagaatggcggtgagccattcagtgaaggagcggaccatctctgagaacagcctgatcatcctactgcagggcctccagggccgggtaaccactgtggacctgcgggat

SEQ ID NO: 87 - DNA, 255 bp, Homo sapiens
gagtcacgccacctaatccattctctcggtcttcgtctgctccggtattgcaactgcctcgattggtcgatcctgggccagcatggcggcgcccatgtaacccggtccgtgccgcaaagcgaacggcggccgcggcgcgggccccgcgggggttagaggtcaccatgctgagggtcgcgtggaggacgctgagtttgattcggacccgggcagttacccaggtcctagtacccgggctgccgggcggtgggagcg

SEQ ID NO: 88 - DNA, 255 bp, Homo sapiens
ggctgggcttcggctcggggcctatgagagccgggctccggggggcgggccggactgtggcggctgccgggggcggtggcggtggtggcggcggcggcggaggcggactggggaggcggcggcctggctcggcctggcctggcctgtcagggcgcgggcggcggcggctccagcaccatgtccctgcagtacggggcggaggagacgcccctcgccggcagttacggcgcggccgattcgtttccaaaggacttc

SEQ ID NO: 89 - DNA, 255 bp, Homo sapiens
agcgccgggagactctgccgtcggtgcgtgcgcggacacgcacccgtcccccttggtctcgccgccagccatggccgccgctacggcctccccccgcagcctccttgttctcctccaggtggtagtgctcgctctggcgcagattagaggtccaccgggagagcggggccccccgggtcccccgggaccgccgggagtgcctggatccgacggcatcgacggtgacaatgggccccctggaaaagctggccctcc

SEQ ID NO: 90 - DNA, 255 bp, Homo sapiens
tcagtctttcgcggcccgggagctcagcagagctaccagctgccctgttggcttcgctggtcggatcgtcctcctggccccgccaaacaggcggggggagcggccccgactgtggggccatggcagtagtctcctcgttcgccgccgccgctagcctagctgagtcgccggcttctgcgctaggggctcccaccgcctccgcaggctaaggagccgctgccaccaacgagctgtgagggttactatgctccctct

SEQ ID NO: 91 - DNA, 255 bp, Homo sapiens
actttgggtttcgaaatgttcgctggctgttccgagaatcagtccgggtcacgttggtgcctctcctttcctgttctgattggttgcttacgtgagcgtgactactttcttgcctcatgattggctgaaatcagtagcgtcatcggcggccgggagggcggagggacgagggaagtcggcgagagggagactgggttgggggaggggttcaggcctgttccccgcggctgcggcagcaccagggccggccgccac

SEQ ID NO: 92 - DNA, 255 bp, Homo sapiens; identical to SEQ ID NO: 28

SEQ ID NO: 93 - DNA, 255 bp, Homo sapiens
agtggggtcacgtgttgcgcgcgagccacctcccctgctggcgcttcctgtcgctaccgctgcggcccagggcccgcgggagcccagggcggtgccgggtgagacaaggccggggtttggctcggattcaccgcgaggtatctaggctgccatgatgccagggccaagacctcggaagggccctcaggccagaggccaaggggtggccgctgccaagcagatggggctctttatggagtttggccctgaggacat

SEQ ID NO: 94 - DNA, 255 bp, Homo sapiens
ccccggatctccggcttccggcaactgggctggaccgaaaccggcgcggagcaactgaggcccgagccttctcgggacccgggggacgcctaaccccgcgagatgaggaaactgaggccgcgaggagcgcgcatacagcagagaagcagcagaatcgggaatcaaacccagctctgtctgaccccagagcctgtgcctttaaccactggctaggctgaactgcctttgttcttcactgtccccatcacctctttc

SEQ ID NO: 95 - DNA, 255 bp, Homo sapiens
tgcagacagtgcgggcctgcgcccagtcccggctgtcctcgccgcgacccctcctcagccctgggcgcgcgcacgctggggccccgcggggctggccgcctagcgagcctgccggtcgaccccagccagcgcagcgacggggcgctgcctggcccaggcgcacacggaagtgcgcttctctgaagtagctttggaaagtagagaagaaaatccagtttgcttcttggagaacactggacagctgaataaatgcag

SEQ ID NO: 96 - DNA, 255 bp, Homo sapiens
gactgtcacccggagtctgtggtttgtcgcccggcgctctggtgtctcgatgtagttcccctggcttctccttatccgcctcgggcaggggggtcgccactgccccttctccaggctctctccaacccctgcccaggctaagcccggcgcggccctactctctgaccccgcgttgcacaatgcccgagcaaagtctccaggggtgtgaaccccggcgtccctgcccctgggcggggacaggcggcggccaagcgg

SEQ ID NO: 97 - DNA, 255 bp, Homo sapiens
gctctgcgttgggccagcccctcacagctggtttcttaccacgtattgcgcaagcggaatctatgcctgttacccacactccctgcgcccccgcaccccgctcctgtgcgcaagtcggaatataaaaccgcggaggagtgagctcttggggtgtccagttggttgccgcggcagtctctccgagcagcgcatttgtcttctaggctgcttggttcgtgcctccgagaaaggggtctcctgctgccagctaagtgt

SEQ ID NO: 98 - DNA, 255 bp, Homo sapiens
gttggcagagcagttgtcctggatggcggagccttgggttccgggggcctgggacctgcaactctttctacaagatatcaagttattctagtacaaccatataaataaataatacctgaagtctcagtgtaacatggacaattaacagtgatgacagataaatacagacgcatggggatcaaatactaggcaaaacgctttttaaaagtgtatcaggcttttaagaaacactgcaggatcctgtctatcttaatg

SEQ ID NO: 99 - DNA, 255 bp, Homo sapiens
cacttccctcaacccttcccacaaactgggaggaaaactgagacctcctggtcacccgccgccgggccttttagaaactcccacaagctctgccttccctccctggtcctcttcagaccccctcttagttcttcgcggctaacggctcgcgctcggggccgggtgtggagctggaacagagggctggcaaggcgcgcatgcgcaccgagggtggagccgctgagcacagaaccggaaacttagagacaaagttcg

SEQ ID NO: 100 - DNA, 255 bp, Homo sapiens
agtcgcgtcaagcaggctattccgggtttgtggctgcttggctccacacgtgggccgccgtaggtattccgaccggtaattcctcctattggtgtgcagcagccacattgaaggatagagtggcagcagaggccaaggatcgtgagttgatggagtttgctgctgaaaatgaagggaagtctgggggaggtctccacagcgtagctgagggggtgcggctaagtccagagcctggcagggagggagtaagggact

SEQ ID NO: 101 - DNA, 255 bp, Homo sapiens
gggtggggccgccgttgccagagaagccactagccggttactagctgcgcttttgttccacttgagcgggcactcttctgcggcaagcaggtctaggaattcgcctggttcccacctcgcgtcccttgccttccttcctagtctacccactgtagtgccccctgcgtcccgctccctcctagccgactcagagcacaagaaggattgccacggtttccattgcagcagccgtggcgcctctgaccctttttttat

SEQ ID NO: 102 - DNA, 255 bp, Homo sapiens
ggagaagaaggcggggctaaaactggcgaaggcgtggcttcttggctgcttgacgaagtgtcgtgaataaaagaaaggagaccgcagaagtaaagaagtggggagtttaggcaagtgcctgatttgggtaatcgaaagcacccagtgattgtatttgatgacttttaagctttcatatgccgttatttaatacctgtcacttccaaatgagagatgtaagggcaacggccgttagcgttctgttttggatcaggc

SEQ ID NO: 103 - DNA, 255 bp, Homo sapiens
ggcggctgctgaacggcggagtggcgtggacctcatgtagcaatgacaatggaaggggccagcgggtcgagttttggaatagacacgattttgtccagtgccagttcaggcagcccaggcatgatgaatggagatttccgcccgctcggtgaggccaggaccgcggattttaggagtcaggccaccccatctccctgttcggagattgataccgtagggacggcgccttcttctcctatctcagtcaccatggag

SEQ ID NO: 104 - DNA, 255 bp, Homo sapiens
attgtcttccaggaaacagctccctcagtttggaatcagctctcccgctgcggccgcagtagccggagccggagccgcagccaccggtgccttcctttcccgccgccgcccagccgccgtccggcctccctcgggcccgagcgcagaccaggctccagccgcgcggcgccggcagcctcgcgctccctctcgggtctctctcgggcctcgggcaccgcgtcctgtggggcggccgcctgcctgcccgcccgcccg

SEQ ID NO: 105 - DNA, 255 bp, Homo sapiens
acgcagccgtcagccgaacaattcgatgacgaggcccaggaagcacgctgaaaccctgggcggcggcaagctgtgcgacctcttctgcggccggcctgggcaggtgtcttcctcgagaggcaggcaggggatcccggacgatgctgtgttctttgctcctttgtgaatgtctgttgctggtagctggttatgctcatgatgatgactggattgaccccacagacatgcttaactatgatgctgcttcaggaacaa

SEQ ID NO: 106 - DNA, 255 bp, Homo sapiens
aaacttatgatgaataaagccaggaactcttgcttattttctgtcctccctctgctcctgtcactaactacttctgtaaacataacttcccaacttctactccaactttaaagcatctggttccttaaataaacaggccctgtagagaggccgtgttgtatggggtgtcagctctgggaagaatgcgtgtgtttgtttgctggctctggcagggttgagtccaagctgacaggactgagtgtgcctgtcagaggc

SEQ ID NO: 107 - DNA, 255 bp, Homo sapiens
acagtctttcctcctcccctcaggaagtaaagtccactagcaggagggcctaaatcgtctgagccctccttggctcttacaatgctcacttgttttcacaatgcagcaaaatgaaatgccttagaaaaagagtaacattccagaaaacggtgtaatttatttttcttccttaattgccccatctgtggaggatttctttgctgaacaccacatcaaagggatcttctgcatttaaaatagaagaggcatcatgct

SEQ ID NO: 108 - DNA, 255 bp, Homo sapiens
ctctccggcgtctccgcctggaggggaagatgcggcctgcctggcccgccgcctcgcccccggcctcacggtgggaccccgggcactgaggacggaggtcccgggcgccggcccgcggggcaacgggcactaggtgagagccggacgcgggcgagcgaaggaggcgggtgccgggcgactccagcggcggcccctgcccctcccccgcacccacgaacacgctcgcccgatatattgcagaggcttctccggtcg

SEQ ID NO: 109 - DNA, 255 bp, Homo sapiens
gcctgcggagaaaagctgggaacggccgcttccggcatgttcatctctggacgaagaacggccgacaagtggagggcggaggagagactccaatgcccagcgggcagtgcgcgggcggcgcttgcgcgatgcgcggacgggggggcggtcgggccatttaaatgtgtgtttgtgggtgaaatggctgcgcaggtcggagcggtgcgcgtagtacgggcggtggcggcgcaggaggagccggacaaagaggggaag

SEQ ID NO: 110 - DNA, 255 bp, Homo sapiens
ggggctagggggtggggctgcagccgggacggggccttcggcagggcctgcgggggcgggacggagcggacccgagtgatacccgggagactagcttggccacaggagacaacgttgaggtacagacaggattattcaagatcaggttgtagccattttcaacaaggatcactgatcaaaattttctttttacaaagagatttacaagttaaacatgaagggaaaatactggaatcatttggattctgacaggat

SEQ ID NO: 111 - DNA, 255 bp, Homo sapiens
gggccgccggctgccagcccagggcggggcggagccctacttctggccgaccgcgtaggcggtgcttgaacttagggctgcttgtggctgggcactcgcgcagaggccggcccgacgagccatggttgctgggagcgacgcggggcgggccctgggggtcctcagcgtggtctgcctgctgcactgctttggtttcatcagctgtttttcccaacaaatatatggtgttgtgtatgggaatgtaactttccatgt

SEQ ID NO: 112 - DNA, 255 bp, Homo sapiens
gtggtagcggggacgcttaggcagggcctgcgcccagtttagaggccaatgcttctcccgtcctttgcatggcacccaagaaggagaaaggaggaactgtgaacaccagttctaagatatgggaaccctcgctcatagctgcacagttcaatcagaacgattggcaggcctccattgcttttgtggttgggaaccagattgaagatgatcttctcatccaagcccttaccgtggctgtccaggtccctcagcgta

SEQ ID NO: 113 - DNA, 255 bp, Homo sapiens
ataagacttttatggatggattgtttttctcaaataatattatcgctttgtgactaaagtaaagattattaattcctgaggcaagaagatataaaagctccagaaacgttgactgggaccactggagacactgaagaaggcaggggcccttagagtcttggttgccaaacagaatgcccatatccgtcttacctgtgaggaagcttgccttgggcgccctctgctggccctcctgaagctaacaggggcgagtgc

SEQ ID NO: 114 - DNA, 255 bp, Homo sapiens
atcagcgaattgcagggtcaagggctggtgctttgaaagagaggcggaggggagagagggattttcccgtccccgctgcgctctgtcctccattactccttttctcggcccgcggcccgaacccgctgtgcggtagaggcagccgggtccctttaaggcccagctgcgcctgtgccttgggctctcctgacacggcccatccggaccctgaggagccagcgggccgcaagcaagttgctgggcggcggtggagat

SEQ ID NO: 115 - DNA, 255 bp, Homo sapiens
gtctcgactggtccattcccggcccacccccattaaccggctcgagccactcccaggacgaagtcaaggcctcggaaggcgactacaactcccagcaggtcgagcagctccgcccgcgctgattctccattggccttccgggggtggggattagatgggaggtggccgtggggctgcggccgggatttgtcccctcttcggcttccgtagaggaagtggcgcggaccttcatttggggtttcggttccccccctt

SEQ ID NO: 116 - DNA, 255 bp, Homo sapiens
ggggggagtcggcgtctctctcccccgcgccagctcccgtacacggagccgcattccttggcccccccacccccctccctcggggcccccccgcccccctcgggaaaaaaatccaccccgaatcactcgaacccgagggaggcttcctttcacccttggggagacgagctttcaacggttacctcttcttcgtctccccccaagcccccgtcccctccccctgctcccacccccttctggcgccgggtgtaaggt

SEQ ID NO: 117 - DNA, 255 bp, Homo sapiens
gcggggaagtggcggctgaagcgccgccggcggggctcactgtggtggtgtgagtgggaggcggcggcgctggtggctgcagctggggtgaggcgcgaggcggcgcactcgacggctgactggagcagcggtaaaggcgaggatggagaccgaaggatataagtcaaagagtacagcagaaaatgtctactgaacggacttcttggacaagcctgtccaccattcagaaaatagccctgggccttgggatcccag

SEQ ID NO: 118 - DNA, 255 bp, Homo sapiens
ataactacttggggacacggagcactgcgtacgccctgggtcatgtgggaaggatgaccgcaaagcctccagtcggcgcgcgggttccggggctgaggggctgaggggcccaaggcgataaccgggatccgctccggccgcgctcctcttgcctttgagaagccccggaagtggcccggctgttggccgcagcgggaggtcttcggaaagaaaaggccggaaccagaagatagactcaacagcgatgccctaccc

SEQ ID NO: 119 - DNA, 255 bp, Homo sapiens
gggcaaggctgggccgggaagggcgtgggttgaggagaggctccagacccgcacgccgcgcgcacagagctctcagcgccgctcccagccacagcctcccgcgcctcgctcagctccaacatggcaaaaatctccagccctacagagactgagcggtgcatcgagtccctgattgctgtcttccagaagtatgctggaaaggatggttataactacactctctccaagacagagttcctaagcttcatgaataca

SEQ ID NO: 120 - DNA, 255 bp, Homo sapiens
actgacctggtactcctcacaccacttaacagccacttgtttcatcccacctgggcattaggttgacttcaaagatgcctcagttactgcaaaacattaatgggatcatcgaggccttcaggcgctatgcaaggacggagggcaactgcacagcgctcacccgaggggagctgaaaagactcttggagcaagagtttgccgatgtgattgtgaaaccccacgatccagcaactgtggatgaggtcctgcgtctgc

SEQ ID NO: 121 - DNA, 255 bp, Homo sapiens
agaggttctcagcctcatgactcctaaactcctggtacttgagcaccgatctgcttcggagaacctgattctgagactccagcaggatgtcttatcaacagtagcaatgtaagcagccctgccagccacctcctgtgtgccgcctgccaaagcgtccagagccatgtccacccctgaagtgccctgagccctgcccaccaccaaagtgtccacagccctgcccacctcagcagtgccagcagaaatatcctctgg

SEQ ID NO: 122 - DNA, 255 bp, Homo sapiens
accactgctggctttttgctgtagctccacattcctgtgcattgaggggttaacattaggctgggaagatgacaaaacttgaagagcatctggagggaattgtcaatatcttccaccaatactcagttcggaaggggcattttgacaccctctctaagggtgagctgaagcagctgcttacaaaggagcttgcaaacaccatcaagaatatcaaagataaagctgtcattgatgaaatattccaaggcctggatg

SEQ ID NO: 123 - DNA, 255 bp, Homo sapiens
gagaaaccagagactgtagcaactctggcagggagaagctgtctctgatggcctgaagctgtgggcagctggccaagcctaaccgctataaaaaggagctgcctctcagccctgcatgtctcttgtcagctgtctttcagaagacctggtggggcaagtccgtgggcatcatgttgaccgagctggagaaagccttgaactctatcatcgacgtctaccacaagtactccctgataaaggggaatttccatgccg

SEQ ID NO: 124 - DNA, 255 bp, Homo sapiens
agcgtccttgtttgtgtggtgccgccgccgccggtgcagccgtcgccgccgccgctgcccccgtctgtaccgcagtgtctgctccgcccgcccgccccggtccggcccgcccccctcccctacccccgtccctagtcccgtcagcagggtctggatcccctgtgccgtcgcctcttcctttttcgacgcctccgccgccgcctgaggaggcgagctagccgggagttacaccgccaccgccaggatggatagaat

SEQ ID NO: 125 - DNA, 255 bp, Homo sapiens
ggtgggggtagcggcggcgcccgcggcccggagcgggggttgggggagtagagaaagcggggcgcgcggaggaacgctgggtccccggcgccgcgggagctgggaggaccgagccggccgagcgagcagcgcggcagcacagtccccgcgtggcgcagcgcggcggggacgcggggaccgcccggatctccttccactgcgccccgcgctctgcggtcctcggccgcctcttcttccttcactcactgcccgggc

SEQ ID NO: 126 - DNA, 255 bp, Homo sapiens
gaccgaagcaagagctggttcaggtggcagccacagcagcctcagggacctcagcaactatggcctcctgcccagactctgataatagctgggtgcttgctggctccgagagcctgccagtggagacactgggcccggcatccaggatggacccagaatctgagagagccctgcaggcccctcacagcccctccaagacagatgggaaagaattagctgggaccatggatggagaagggacgctcttccagactg

SEQ ID NO: 127 - DNA, 255 bp, Homo sapiens
ggttccggttgctgccgccgctggcgggcggcgagtctggagagagcgcgcagtttgcgcggcggctcggcgcttccctgtcgtcgcactttgtggttgctgcagctcgggggcctgggctgcccctgacaccccttctgggcgatggtgcagcccaagggcgcctccatcccccgccgctgccgctaacccgggtcccccactccatggccgcctcggcgccgcccccaccggacaagctggagggaggtggcg

SEQ ID NO: 128 - DNA, 255 bp, Homo sapiens
agagaagaggctccacgttgggcggggatggggcctgaaactgtctgggtctgagctggggagcggaagccacttgtccctctccctccccaggacttctgtgactcctgggccacagaggtccaaccaggctaagggcctggggataccccctgcctggcccccttgcccaaactggcaggggggccaggctgggcagcagcccctctttcacctcaactatggatctcctgccccccaagcccaagtacaatc

SEQ ID NO: 129 - DNA, 255 bp, Homo sapiens
agaatacggtgagaaattccaggagcacagaagtcagcgggcatctcctggagacaggcagacatttggtctcagcagccatgcccaaagtcatgaaggatgttgtgcaccccttggggggagaggagcctagcatggcgagagctgtggttcgcagcgtgggaggttttaccctgggcttgtctttagccacggcctacgggcttctggagctactggtggaaggccacagcccctggggttgcctggtgggca

SEQ ID NO: 130 - DNA, 255 bp, Homo sapiens
ctctctctctctcgctcgctctctcgctctctcgctctctctcgctcgctctctcgctctcgctctctctctctctccggctcgccagcgacacttgttcgttcaacttgaccaatgagacttgaggaagggctctgagtcccgcctctgcatgagtgaccgtctcttttccaatccaggtcccgccccgactccccagggctgcttttctcgcggctgcgggtggtcgggctgcatcctgccttcagagtctta

SEQ ID NO: 131 - DNA, 255 bp, Homo sapiens
aggagtggaaggttgaggggggcgctaggcgcccttcgctccctccctctggaggagctgccgccgccaccgccgccactctgctgctgccgccgccgccgccgccgctcccgccgccattttgggttcgctttgcggaggggagacgatcccagtctcggttgcgggacccgcctcccctcagtttgccccctttagccttccacctttcccttctcctctctcgcatttccgccagtcagcttacccgctggc

SEQ ID NO: 132 - DNA, 255 bp, Homo sapiens
gactcgggcgccggtggcgccatcttactcggttgcgggaggggtcacaggtcagtgccggagcctccgcgagtgaaggaagacgaagtgcgtgacccgaccggctgtggtgttccagtccccactgaccagtaggagcagcagggcgtcggcttgtgaggtggcttttcctcggggcaaccgaggaaggccccaagaggacaatggattctggaactcgcccagttggtagctgctgtagcagccccgctgggc

SEQ ID NO: 133 - DNA, 255 bp, Homo sapiens
ctttccccccacccctcaagctaggctgagctgtgcctacgtcggcctcgactcccgggggctggaggagttacctttggagcccgaaaggaggaaggaagcaaaatatcaacaacagccgaggcggctcaggcgctcggccccggttccccgcttgcctgccgcccgcctgctggcccccgcgcccacgacgggggcccaggcctcacggcgccgcccagggcccgcgcggacgccggcctcatttattattct

SEQ ID NO: 134 - DNA, 255 bp, Homo sapiens
tcagccaattagagctccagttgtcactcctacccacactgggcctgggggtgaagggaagtgtttattaggggtacatgtgaagccgtccagaagtgtcagagtctttgtagctttgaaagtcacctaggttatttgggcatgctctcctgagtcctctgctagttaagctctctgaaaagaaggtggcagacccggtttgctgatcgccccagggatcaggaggctgatcccaaagttgtcagatggagagta

SEQ ID NO: 135 - DNA, 255 bp, Homo sapiens
agaagggagacagtggcggtcgcggcggggccgatccgagagttccccttagagaacggagctcacgggcggggaggcctcacctgctagtaggacgcagaaagacagaaggcgaaggagaccccgacttcccgggtcagccccagagccaccccctgccgtagccatcttgcctctctgctgagcggaagcccccgttcggctcctgtctgttagcggcctctctaggctaccactgacaccgtctctgtggcc

SEQ ID NO: 136 - DNA, 255 bp, Homo sapiens
cgcccgcctgtcccctcccccacggccgcggcggcggcggcggcggcggctgctggagcccggatgcggcgccgtgaggcaggcccgggagagcggcgcggatggatccaacatggcggcgccgagcctgagccgagagaagagacctgggaaattaagtttcttgcggagtacggtggggattgcagctgctgagcagggattctggaaagcattgcgtacctgagcccccagcatggcgggcctaaagcggcg

SEQ ID NO: 137 - DNA, 255 bp, Homo sapiens
gggcaccttccctgcgaaaaggcgggcggagccgaaaaccaaacaaacgacttctgagagattgggggcgggactgacggcggccggcttagcttccagagccaaggccttccgccgagttggtttttgggttgttgatcgcggtggccgggcggtctgcggtcgggctgagacacgcggagcaatggcgacctttgtgagcgagctggaggcggccaagaagaacttaagcgaggccctgggggacaacgtgaa

SEQ ID NO: 138 - DNA, 255 bp, Homo sapiens
ctacccctttgtgagcagtctaggactttgtacacctgttaagtagggagaaggcaggggaggtggctggtttaaggggaacttgagggaagtagggaagactcctcttgggacctttggagtaggtgacacatgagcccagccccagctcacctgccaatccagctgaggagctcacctgccaatccagctgaggctgggcagaggtgggtgagaagagggaaaattgcagggacctccagttgggccaggcca

SEQ ID NO: 139 - DNA, 255 bp, Homo sapiens
tgctttctcaaaggccccacagtcctccacttcctggggaggtagctgcagaataaaaccagcagagactccttttctcctaaccgtcccggccaccgctgcctcagcctctgcctcccagcctctttctgagggaaaggacaagatgaagtggaaggcgcttttcaccgcggccatcctgcaggcacagttgccgattacagaggcacagagctttggcctgctggatcccaaactctgctacctgctggatgg

SEQ ID NO: 140 - DNA, 255 bp, Homo sapiens
gcaagaactgcaggggaggaggacgctgccacccacagcctctagagctcattgcagctgggacagcccggagtgtggttagcagctcggcaagcgctgcccaggtcctggggtggtggcagccagcgggagcaggaaaggaagcatgttcccaggctgcccacgcctctgggtcctggtggtcttgggcaccagctgggtaggctgggggagccaagggacagaagcggcacagctaaggcagttctacgtggc

SEQ ID NO: 141 - DNA, 255 bp, Homo sapiens
gctgcgggtcgttagctgtcagagccaagcggcgggctggcggcgggctccgacgtctgcgccaggacctggctggctgagcccggcgcagcagcagcagccagggcagcgcggcccctactccctgtcaggtcgtagaggcgagcagggaccagctggtcgccggcccctcgggcaagatggggaaccgggagatggaggagctgatcccgctggtgaaccgtctgcaggacgcgttttcggcgctgggacaga

SEQ ID NO: 142 - DNA, 255 bp, Homo sapiens
agggcgcgtctggggcgtgtgcgcccaaggccagaggcacccgaggtgggctggcccagggtggaaagcctgggccgagcccctggagcgggcggaacggcgagccagattcaggaagttgtgcctgtgacatcaggggcaggacagagttggagcgaaacctcaactatgccaggcgtcggcccgtaggaaggcagggaacacagagggcgctgccctcggcggcagcggcagggcccggggcgctgtcagacg

SEQ ID NO: 143 - DNA, 255 bp, Homo sapiens
gacattcgggccgcggcggccgctgggtgcagccgagcggtgtggagcggagagaatactcgaagggctctcctgatactaacagttttacgatttaaaacttcgccagaatttcgacagggtctcactgtattgcccaggttggtctcgaactcctggcttcaagcgattctcccacctcagcctcccaaagtgctgggattacaggcgtgagccaccacgcctggcctcactcaaacagtaaacgaggtatgt

SEQ ID NO: 144 - DNA, 255 bp, Homo sapiens
cctccccgaacccagcagctggcctgggagggagaaggggctggagagggcctggcctctccgagggatggaggggacagaggcggcggcggccaaacccgcgggcggcagcccccaagggcccaagacagggagtggaacagccagccccgtggaggggacctcagctgtggagtggagtggtcctgagccacagctggataacggacaccccccaagaccctggccttgccctcaggaaaacagaacatccag

SEQ ID NO: 145 - DNA, 255 bp, Homo sapiens
gttggggaggcggtttcctagactacgacaccggaaagctgggggaggcgctccgggatactgagggcggagggcggtggcagcgctggcgctggggaccggcttggtggcttcgggaaacagtttggcgccggcggccgtccgtgttactccgcatcccgccccgtctcggcacggctagcagccccctggccaccagcgtccagcaatgtgtctcaccggccgggcgtagcagctgcgcgtgcgcggaaccgc

SEQ ID NO: 146 - DNA, 255 bp, Homo sapiens
gtcgggaagtaggcggggtgacgtgtggttgacgagctcggcggcgggtttgctgagatctgtggccggcggcagctggtgcggggggcagctgagagcgagaggtggatcggggcggtgtgtggccagggccatgacgggcaatgccggggagtggtgcctcatggaaagcgaccccggggtcttcaccgagctcattaaaggattcggttgccgaggagcccaagtagaagaaatatggagtttagagcctga

SEQ ID NO: 147 - DNA, 255 bp, Homo sapiens
gacttcctgatttgcaagaaggtgcaggagccgcagcgggcggccccggtcgcaggaactgagaggcctcagctttggtggcggctaccggcggagacgggggcggcggccacgccaccgctgctgtcacagaaaggctctggtgggtggggtgggaggcggggaagtgccgggggcgcagccgacatgggcccgccgccacggctgctgtgagcagcctctttccctgtgtggccgccggcgtgggcggggacg

SEQ ID NO: 148 - DNA, 255 bp, Homo sapiens
cgcggtggccccgcctccccgccgcccggaaagcgggctgcggccccctcccaaaacccggggaagtggattctactctacgctccgctccgctccgctccgcaccaccaaccccgggccgcagtcctgacgagcgggtcagggcttgtcgggcggaagcctggcctggagcctggaagggggagacggcccgagcgggagcgggagcggacgcggcctcagtcctgcgcggaatattgaaggatgtttgttcca

SEQ ID NO: 149 - DNA, 255 bp, Homo sapiens
gggaggtggctgccgggtgggaggtgtgtgcgcgtgtgccgcgccgtagggagcggcgggtcgcgccgccggctgtcagctagctccgcgccgccgcccgatggcgcgaggaggcgcgcgggcccagccccggggggccggccgcgggtgagcccctcggcctgccgcccgcgagcatgtcacctccagccgccgccgccgcagcctccgccagccgcgcccgcgcccccgcctcccgcagccgcagccgctgcc

SEQ ID NO: 150 - DNA, 255 bp, Homo sapiens
atcggcgagccgattccggggcagcgagtcgtcggcagccgcgctcgagcctccgcccgcaccgagccgcgggacccgggccgtaccggggaggggccgctccgggccgcagcgcgagggcagcgaggggcggcggggacctggcaccgggcggggccggcggcagcgaccatgatcgctttgttcaacaagctgctggactggttcaaggccctattctggaaggaggagatggagctcacgctggtcgggctt

SEQ ID NO: 151 - DNA, 255 bp, Homo sapiens
ctccgacccgccccgcggcgcattgtgggatctgtcggcttgtcaggtggtggaggaaaaggcgctccgtcatggggatccagacgagccccgtcctgctggcctccctgggggtggggctggtcactctgctcggcctggctgtgggctcctacttggttcggaggtcccgccggcctcaggtcactctcctggaccccaatgaaaagtacctgctacgactgctagacaagacgactgtgagccacaacacca

SEQ ID NO: 152 - DNA, 255 bp, Homo sapiens
caggccccccaacggctgacccctgcacactccaccctggccccccagccagtccagcaatgatggaaaaaaacacctccgagggccctgcctgcagtccagaggagaccgcatctgaatctgccaaggtgcccacagcagagcctcccggagaagtggcagtatcagagtccaccagagaagagcaggtgcccaagccgcaggcccctgccccacaggcccctacagcctccacagccactaagcctgcacccc

SEQ ID NO: 153 - DNA, 255 bp, Homo sapiens
cacatagctcagttcccataaaagggctggtttgccgcgtcggggagtggagtgggacaggtatataaaggaagtacagggcctggggaagaggccctgtctaggtagctggcaccaggagccgtgggcaagggaagaggccacaccctgccctgctctgctgcagccagaatgggtgtgaaggcgtctcaaacaggctttgtggtcctggtgctgctccagtgctgctctgcatacaaactggtctgctactac

SEQ ID NO: 154 - DNA, 255 bp, Homo sapiens
aagaatcagaagacatttgtgctttggggagcagaggccctcagggtatagagaaggaagaagagagaggttcactgtagtcctgaagcagaaataagacctgtggctgaaggaagccttagcaattcactccttcctcttcctgagaactctctgtaggaagtctcacctagcagaggcttcacagtatttcagagaagccaaagattgtttgcctctttggaaactgttatccttccatcatgactgtgtcac

SEQ ID NO: 155 - DNA, 255 bp, Homo sapiens
gtgctttactgcgcgctctggtactgctgtggctccccgtcctggtgcgggacctgtgccccgcgcttcagccctccccgcacagcctactgattcccctgccgcccttgctcacctcctgctcgccatggagtcgctggttttcgcgcggcgctccggccccactccctcggccgcagagctagcccggccgctggcggaagggctgatcaagtcgcccaagcccctaatgaagaagcaggcggtgaagcggca

SEQ ID NO: 156 - DNA, 255 bp, Homo sapiens
gcacaaaccctagtgggtttggttgcacggcggctttggcgcattttcggctggtttgattcatccattttgaagagacgggggagcggggggctcgtctgttccaggagccctgaaccaaagagcagcggagtttgagaagccagcagctcggggttcggcagcagcggtcccatcggctgaagttcggggggggtggggcgccgagcgcgcggggtggggggggtcctggtctttggcttctcgactcggtcc

SEQ ID NO: 157 - DNA, 255 bp, Homo sapiens
agcctgagaatagttagcaaacaagggaggttgtcatttcctcatcgtcaagctttgttcctcgtgggggctagaaatctctttccagttccagattgtgaagggttcctgagtaagcagcgtgtctccatccccctctctaggggctcttggatggaccttgcactctagaagggacaatggacttctggctttggccactttacttcctgccagtatcgggggccctgaggatcctcccagaagtaaaggtag

SEQ ID NO: 158 - DNA, 255 bp, Homo sapiens
cgccgccgccgccgccaccgcgggagccagagctgccgggaggagcggcatccgcgccagactggagcgggagggcggcggagggcagttgctgggaatttttcagccgagagggcgagcgatccggagagagaccccgagagcttgggagcggtagggcgtgcgagcgccgcagccagcggagcaaacctcgaaatagatctggaaagccaggctcccggaggaaatgggactgtgaacgaaccggagagcaag

SEQ ID NO: 159 - DNA, 255 bp, Homo sapiens
gcggccgcgggggcccctcagcggtttcccgaacggcccgactcgggcgctcctccgtgtcgcggtcgccgaccctccgcgtcccgccaacgccgccgctgcaccagtctccgggccgggctcggcgggccccgcagccgcagccatggggtgttggggtcggaaccggggccggctgctgtgcatgctggcgctgaccttcatgttcatggtgctggaggtggtggtgagccgggtgacctcgtcgctggcgat

SEQ ID NO: 160 - DNA, 255 bp, Homo sapiens
ctccccgccagtccgggcgaacgcggccgggcccttggggaccgagtctcggcgccgccggggaacgggcgcgggccgcgccacagccggagcggggcagggccccgccaccgccttcttccgccggccccgccgccggccatgcattcttccggctcctctgactcccaaagccccggctggggcccggccagcccgagaaagacaggacggagtccagtgtgagaatggctataactttggaagaagctccgt

SEQ ID NO: 161 - DNA, 255 bp, Homo sapiens
cggcgagactgcacctcccagcatgccttgcagccaggactggagtcggtacttaagagtgatggggttccctagatactttaggccgtcgcatcgattatagagattgaggtggaacccggggcctgggaactggacgcacgcggagggcgaagatggaagcctggcgctgtgtgaggaagggctacggccactgtgtggtgggaagaggccgataccccatgtttccccatcactcgaggagtctgggcagag

SEQ ID NO: 162 - DNA, 255 bp, Homo sapiens
gcagtactcggagacagcggacccgtgtcagtgacagcttccggtttggtttctccgccttctgcttggctagagctattggggctcggtggcggccgcagtggggtggagggggcagggcgtggtgaggtaaggtgagtgccgtagtggggttccctggagccatggcctgctccattgtccagttctgctacttccaggacctccaggccgcccgggacttcctctttcctcacctgcgggaggagatcctca

SEQ ID NO: 163 - DNA, 255 bp, Homo sapiens
gctggggcccgacccgggattagttggtttcggagcggaggagggagccccgaccgtcacgagcgtcgaagagacaaagccgcgtcagggggcccggccggggcgggggagcccggggcttgttggtgccccagcccgcgcggagggcccttcggacccgcgcgccgccgctgccgccgccgccgcctcgcaacaggtccgggcggcctcgctctccgctcccctcccccgcatccgcgaccctccggggcacct

SEQ ID NO: 164 - DNA, 255 bp, Homo sapiens
ctacgaggcccccggttgactaggagctggcggtccgagctgtggcttggaagaccgacgcgatgaagcccagacctgcagggttcgtggataataaactcaagcagcgagtcatccagtaccttaccagtaacaaatgtggcaaatatgtggacattggagtcttagcgtctgatttacaaagagtgtacagtatagactatggtcgaagaaaaagaaatgcttttaggattcaggtagaaaaagtatttagca

SEQ ID NO: 165 - DNA, 255 bp, Homo sapiens
acgtttgcagatgctctccctgcgccgcgaccaccctgtgcttggcccagttctcccggaggcgtccagagactgggctcgtgccgggggacggaagagggtgcgccccggcggatcccttcttggagcctggacgtgagctggccggtccggggcttgcagacctccgggaggagctgcggggctgagcggcgaccaggaggccaggccggggcagaggaccgccgagggccaccgcgggaggcgcagtcagct

SEQ ID NO: 166 - DNA, 255 bp, Homo sapiens
aggcatcagcaatctatcagggaacggcggtggccggtgcggcgtgttcggtggcggctctggccgctcaggcgcctgcggctgggtgagcgcacgcgaggcggcgaggcggcagcgtgtttctaggtcgtggcgtcgggcttccggagctttggcggcagctaggggaggatggcggagtcttcggataagctctatcgagtcgagtacgccaagagcgggcgcgcctcttgcaagaaatgcagcgagagcatc

SEQ ID NO: 167 - DNA, 255 bp, Homo sapiens
cctcttttttgtcttccatagcttgtgagaaaataatttctgagcatttttacttttaaagccatctcgtccctacgaggtttgcgcctctgggcatgtagtctacacaggacctgagaatctgagaaactgcagccgcacggttgtttatggagctttgggcgggggctgagcccgcggtcgtgcccccagcccgctgcccaggccatgccgccccatctgcgcgcggagccgcggctgccgggcctccggggc

SEQ ID NO: 168 - DNA, 255 bp, Homo sapiens
atggagtgggtgctcgcggaagcgctgctctcgcagagccgggacccccgggccctgcttggggcgctgtgccaaggggaggcatccgcggagcgcgtggagacgctgcgcttccttctgcagcggctcgaggacgaggaggcgcgcggcagcgggggcgcaggcgcgctcccggaggcggcgcgcgaggtggctgcagggtacctcgtgccactgctgcggagcctgcgcggacgccccgcgggcggcccggac

SEQ ID NO: 169 - DNA, 255 bp, Homo sapiens
ataagaaaaaaaatattttaaaagggtaaccgttaaacagctaggacctgcaacttcagtgcttctgggataactggaacatcagaaggacagattttattacagcataatcacacctcatttctttcatcagcagttgtcaccagacgctgttacttcctaaaatggcggacaatcttcccacagagtttgatgtggttataatagggacaggtttgcccgaatccatccttgcagctgcatgttcaagaagtg

SEQ ID NO: 170 - DNA, 255 bp, Homo sapiens
gctgagtcatcactagagagtgggaagggcagcagcagcagagaatccaaaccctaaagctgatatcacaaagtaccatttctccaagttgggggctcagaggggagtcatcatgagcgatgttaccattgtgaaagaaggttgggttcagaagaggggagaatatataaaaaactggaggccaagatacttccttttgaagacagatggctcattcataggatataaagagaaacctcaagatgtggatttacc

SEQ ID NO: 171 - DNA, 255 bp, Homo sapiens
ccgcgcccgccccgcccctcgggcgtacgtgtgcgcgcagggcgcaggcgcgcgggtcccggcagcccgtgagacgcccgctgctggacgcgggtagccgtctgaggtgccggagctgcgggaggatggagccgctgaaggtggaaaagttcgcaaccgccaagaggggaaacgggctgcgcgccgtgaccccgctgcgccccggagagctactcttccgctcggatcccttggcgtacacggtgtgcaagggga

SEQ ID NO: 172 - DNA, 255 bp, Homo sapiens
tggggctcgagggggcgagcggtggcggtggcgggtacggcaggctcgcgggcgccgggcttcgttacataatctcggaccggaggagcggcggcacatggcggcggagcggcgctgtggaagtatgcgagacttaagagctcaagtgactagtggtctcctgccatttccagaagtgactcttcaagcccttggagaagacgaaataacattagaatctgtgcttcgtggaaagtttgctgcagggaaaaatgg

SEQ ID NO: 173 - DNA, 255 bp, Homo sapiens
atggaaaaaagaaatctaacagttgtcagggaattcgtccttctgggacttcctagctcagcagagcagcagcacctcctgtctgtgctctttctctgtatgtatttagccaccaccttggggaacatgctcatcattgcgacgattggctttgactctcacctccattcccctatgtacttcttccttagtaacttggcctttgttgacatctgctttacgtcgactacagtcccccaaatggtagtgaatatc

SEQ ID NO: 174 - DNA, 255 bp, Homo sapiens
ttccagttacagctatatcagagaatgagttaatctcctcagaaatcactaaatactactctgaggggcttagaaattaacaggttgtttatataattggccttaaatgaggtgagagtgaagagactagagccatctctggaaaacatcattatcccattccccgggaagctaccctctggaactcaagatttgaccatatctgttttgaggattcattatgaacaaagaagtctcccaggtgtgaagtttttc

SEQ ID NO: 175 - DNA, 255 bp, Homo sapiens
tcgctcctggctaacatggccgaaaggtcgtattctccgggggaggacgggggcccggagaggagggggtggagtgcctggttttccagtcaggcggccggagggcagccctcaagaacggccctgaccgcccgcggggtgaggggccctttctgggcaggacccgccccttggtcccgcagagccttggtacttggacctgaaccttgctccgagagggagtcctcgcggacgtcagccaagattccagaatga

SEQ ID NO: 176 - DNA, 255 bp, Homo sapiens
ccggggcaccggcggtgggcggggccagcagcgcaaactgcctgcagcggggaccggacctgcacaggccgcctatggcgggcggcgggtgggaccgcgagttacagccggccaactggggccagccaggagcctgagggtcggaagcccccaacacaagatgctgagctccttcctgagcccccagaatggcacctgggcagacaccttctctctgctcttggctcttgccgttgccctctacttgggctacta

SEQ ID NO: 177 - DNA, 255 bp, Homo sapiens
ggcccgagccaccgactgcaggaggagaaggggttgtgctcctggccgaggaaggagaaaggggcggggccggcgggcagcgtgcggcagtgcggagctcctgagaccggcgggcacacgggggtctgtggcccccgccgtagcagtggctgccgccgtcgcttggttcccgtcggtctgcgggaggcgggttatggcggcggcggcagtgagagctgtgaatgaattctccgggtggacgagggaagaagaaag

SEQ ID NO: 178 - DNA, 255 bp, Homo sapiens
gcatggccaaggccgggcggccgccttgcccccgcttcctttcacgctgtcgctgcccgtaggtggttgtggccactgtgcccggagggaggcggcggtggccagtaatgcctgggaaactcctctggggggacattatggagctggaagcacccttggaggagtccgagagccagaagaaggagaggcaaaagagtgacagaaggaagtcaaggcaccattatgactcggatgagaaatcagaaacaagagaaa

SEQ ID NO: 179 - DNA, 255 bp, Homo sapiens
gtagcccggaaggggaatacttccaagttgtagtgttgttgttttcagcctgctgctgctgctgctgttgcggctaggggaaccgtcgtggggaaggatggtgtgcgaaaaatgtgaaaagaaacttggtactgttatcactccagatacatggaaagatggtgctaggaataccacagaaagtggtggaagaaagctgaatgaaaataaagctttgacttcaaaaaaagcaagatttgatccatatggaaagaa

SEQ ID NO: 180 - DNA, 255 bp, Homo sapiens
aagctgattgggtgtggtcgccgtggccggacgccgctcgggggacgtgggaggggaggcgggaaacagcttagtgggtgtggggtcgcgcattttcttcaaccaggaggtgaggaggtttcgacatggcggtgcagccgaaggagacgctgcagttggagagcgcggccgaggtcggcttcgtgcgcttctttcagggcatgccggagaagccgaccaccacagtgcgccttttcgaccggggcgacttctata

SEQ ID NO: 181 - DNA, 255 bp, Homo sapiens
ggggatgtggtgctgccggggccgccactgcagctgctgctgcctgctggttgccgcgtcttcccggaggcgactgctggaagctgcagggaacagctgcggtgctctgccatattgtgtcttccccggccggtccctcgcctcccggccgagctgacgttggttgaagccatggataacagaacccacagatgcagagggctgactgtacaagtctgtcaaaaaaccaaactgctggttggctaataattggtc

SEQ ID NO: 182 - DNA, 255 bp, Homo sapiens
ttcacttccgggccgcggtctagggcggctacgtgtgttgccatagcgaccattttgcattaactggttggtagcttctatcctgggggctgagcgactgcgggccagctcttcccctactccctctcggctccttgtggcccaaaggcctaaccggggtccggcggtctggcctagggatcttccccgttgcccctttggggcgggatggctgcggaagaagaagacgaggtggagtgggtagtggagagcatc

SEQ ID NO: 183 - DNA, 255 bp, Homo sapiens
agcggactgcgcatgtgcaggacccagcaggtctagagcttttctgtgtttctccggacttcgagccatggcggtgacggaagcgagcctgttgcgccagtgccccctgcttctgccccagaaccggtcgaaaaccgtgtatgagggattcatctcggctcagggaagagacttccaccttaggatagtgttgcctgaagatttacaactgaagaatgcaagattattatgtagttggcagctgagaacaatact

SEQ ID NO: 184 - DNA, 255 bp, Homo sapiens
cttctggcagtttctgggagctgcgaacgcgccgccccggggctcggcggccggaaacgctggcttcggagccttaggcgccgcggcctttccttgttttccgcccagtccacgccgccatggccaagtggggccaggggaacccccactggatcgtggaggagcgggaggacgggaccaacgtgaacaactggcgctggcgcggctggcggcggcctccttccgggatctggggagggccgggccgcgggagcc

SEQ ID NO: 185 - DNA, 255 bp, Homo sapiens
acatacccggggagggcagtagaaaggtgatcaatcttcatcaggctacatttccaatcacctaaacaaccgagcaagacaagccactccgacaaggttggctgcccggcgggtctctgtgagagatccaggtagatggtgaacggccccggcagctgagggcaggccaggcccccagacgcatcagaccctgaaggactgcgtggtgggagccctgcaccgctcctggccccgggccccctggatccgtcgggg

SEQ ID NO: 186 - DNA, 4124 bp, Homo sapiens
gtgtcggcggcagcggttcccccgctgcatgatgggagagtgtgtggagtgggcggggggtctccgcggaggaggtggaggaggcggcggcggcggcggaagagggcggagggtagtgggatgggggtcccgcggcagcggtgaaactccgggtgggcgtccatggtgctgctgcgctgacagggctgtgagcagccggccttccgctctcaccagttccgcgtcggaatagacggtccttccccggggagtcagttcctccccgggcccctgagccatgcccatcgcagccgccccgaaggagccaggtgtaaattaattatttgaaagcaactgaacaatggagccagacatcattcgaatgtactcttcatccccaccaccattagacaatggagcagaggatgatgatgatgatgaatttggggaatttggtgggttttcagaagttagcccttctggtgtagggtttgttgatttcgatacaccagattatactcgtcccaaggaagagtttgtaccttcaaaccattttatgccaattcatgaattctcagaaaatgtagatagccttacaagctttaagtccattaaaaatggtaatgataaggacatcactgctgaactttctgctcctgtgaaaggacagtctgatgttttactttctaccaccagcaaagaaataatttcatctgaaatgttagctacttccattgatggcatggaaagaccaggaaatttaaataaagtagtggagcagagacagaatgttggaacacttgaaagtttctctccaggagattttagaactaatatgaatgttgttcatcaaaacaagcagttagagagctgcaatggtgaaaagcctccttgtctggagattctaacaaatgggtttgcagtgttggaaactgtaaatcctcagggaacagatgatctggacaatgtagctgattcaaagggacggaagcctcttagcactcatagcactgagtataatttagactctgtacctagtcctgctgaggaatttgcagattttgccacattttccaaaaaggaaaggatacaattagaagaaatagaatgtgcagttttaaatgatagagaagcactaaccattcgggaaaacaataaaattaatagagtcaatgaactgaattctgtaaaagaagtggctttgggtagaagcttggataacaaaggagacactgatggagaggatcaggtttgtgtttcagaaataagcatagtgactaacagaggtttcagtgttgaaaaacaaggccttccaacactgcaacaggatgaatttttacagtcaggtgttcagtcaaaggcttggagtttggtagactcagctgataattcagaagccattaggagagaacaatgtaaaactgaagaaaaacttgacttacttacttctaaatgtgctcacctatgcatggattctgttaaaacttctgatgatgaagttggttctcccaaagaagaaagtagaaagtttactaatttccaaagcccaaacattgaccccacagaagaaaatgatttggatgattctttaagtgtaaaaaatggtgatagtagtaatgactttgtgacttgcaatgatatcaatgaagatgattttggtgattttggtgactttggctctgccagtggctcaactccaccttttgttactggtactcaagattcaatgagtgatgccacttttgaagagtcttcagagcactttccacattttagtgaaccaggtgatgactttggagaatttggggatataaatgctgtttcttgccaagaggagacaatattaacaaagtcagacctaaaacagacttctgataatttatcagaagaatgtcaattggcaagaaaatctagtggaacaggcactgaacctgttgcaaaacttaaaaatgggcaagaaggtgagattggacattttgattctgtgccaaatattcaggatgactgcaatggttttcaagactctgatgattttgcagacttcagttcagctggtcctagccaagttgtagattggaatgcttttgaggatgaacaaaaagatagttgttcttgggctgcttttggagaccagcaggctactgaatctcatcatcgaaaggaagcctggcagtcacataggacagatgaaaatattgatactccaggaacccccaaaacgcacagtgtaccttcagcaacttccaaaggagcagttgctagtggccatttacaggaatcagccacttcagttcagacagctttattaaaccgcctggagcgaattttcgaagcatgttttccttccatacttgtccctgatgctgaagaggaagttacttccctgaagcacttgctggaaacaagcactttgccaataaaaacgagagaggccttacctgaaagtggggaattgctagatgtgtggactgagctacaggatatccatgatgcacatggcttgagataccagtggggcggctcccatagcaacaagaagcttttgtcctccttgggaatagacacccgaaacattctcttcacgggcaataagaagcagcctgttatagtgcccatgtatgcagcaggattgggtatgttagagcccaccaaggaaccactgaaaccactttctgctgcagaaaaaatagcttccatcggtcagacagccaccatgtcaccagatatgaacacatgtacatctgatcagttccaggagtctctaccacccgtccagtttgactggagtagcagtggccttactaaccctttagatgctagtggaggttccactcttctgaaccttgatttctttgggcccgtggatgacagtagctctagcagcagcaccacaatcccaggtgtggatccggagttgtatgagttaacaacttctaagctggaaatctccacctcaagcctcaaagtgactgatgcatttgcaagactcatgtctacagtagagaagacaagcacatctaccagtaggaaaccgaaaagagaagagcacctaagtgaagaagctatcaaggtgatcgctggccttcctgacttaacattcatgcatgccaaggtgttgatgttcccagccacgttaacaccttccacaagctctcaagaaaaagcagacggataactgatgtgaattggacagtttctattgcttttccttttttccatcccttccctaccatcaaaagcatacctgctctaattaaaaaaaaaaaaaaaaaaaattcaagttcagctgatttgttggtaagccgcactagaaaggtatacatagtaatgtatatttatttacatactgaagtcctaaatttatattagaaaaatgtaaataatcgggggtaaacatttttgaagatttattctttttgtgttgctggggtgtatacatttatgtctttgtgaaatacactggtggtgtccttcttacaaaacttttgaaataaaaaaaaaactcaaatcttcactgtctgtgaaatccccttcagtcttttcagattgcattgactgtcctcttgatttttcatattacatgtcaaattacttttgctatcataaataagctccaaagtcccccatttaatttttttttaattttgtgtatgatgggtttcagatctggcttttgttaacattttggggcttttttaatcttttcaatctggcgtattgctgtttgaccttttgcaaggtacttaattgctcttttgttatagggtatggatcattgtcagaacttgattggaggggtttaaagagattgtgtctgtttaaaatcagtatgattcagagaaggaccaaattatatgaatgtcttacaatggaatttacttgttactgatttttttgttctattgtaccactattttttgaggattttgcacagtgtaaaatgacataatcatagattgctatggtttaggctgtatatacagtgaaaactatgggttttaaatgtttggggaaattcctatggaaaaaagagagacatgtagaagaacctctaacaaggttaatgtgcatgcccaaggtcttttgaaatttcagtgtgtaaatttccttttagcttatacaaaaataaaataatttaaaagaaa

SEQ ID NO: 187 - DNA, 5827 bp, Homo sapiens
gtggttggcgctcggtcctgccctgcgcgttttgggctgcggttggagggccgcagttgcagtcagggtccgccagctcggggccagcgcatggggctgctgagaccgctccggacgtgcgaagcgttcgcggtgcggaagctgaagtcttcagcagaaccctgacctaggtagggagtctcaatggccctgggtgaagaaaaggcagaagcggaagcatctgaagacacaaaggcccagtcctatgggagagggagctgcagggagcgggagctggacatcccagggcccatgagtggggagcagcccccacgcctggaagctgagggagggctcatctcccctgtatggggggcagaagggatacctgcccctacttgctggattgggactgaccctggcggcccctctagagcccaccagccacaggccagtgatgccaacagagagcccgtagctgagaggtctgagcctgcactcagtggcctgcctcctgccaccatggggtctggagaccttctgctctccggggaaagccaggtggagaagaccaagctttcttcctccgaggagttccctcagactctgagccttcccagaacaacaactatttgctcaggacatgatgctgataccgaagatgatccatccctagcagatttgccccaggcactggacctcagccagcagcctcacagctcaggtctctcttgcctgtcacagtggaagtccgtgctgagcccaggttccgcagctcagccttccagctgcagcatctctgcttcctccacaggcagcagtctccagggtcaccaggagagggcggagcctcgtggtggttctctggccaaggtctcctcctccctggagccggtcgtcccccaggaaccttcctctgtggtggggctaggacctcggccccagtggtcaccacagcctgtgttctctgggggtgatgcttctgggctaggcaggagacgcctctccttccaggctgagtactgggcctgtgtgctgccagattccctgcctccatcacccgaccgccactcccctctctggaacccaaataaagagtatgaagatctgcttgactatacttacccactgaggcccgggcctcagctcccaaagcaccttgatagccgtgtgccagctgaccctgtcctgcaggactccggggtagacctggatagcttctctgtctctccagcaagcaccctcaaatcacctactaatgtctcccccaactgcccaccagcagaggccactgccctgccattttctgggcccagagagccaagccttaagcagtggccctccagagtaccccagaaacagggtggcatgggcttggcatcttggagccaacttgcatctacccccagagccccaggcagtagggatgctcgttgggagcgcagagagccagccctgaggggtgcgaaggaccggctgactataggcaagcaccttgatatgggctctccccagctaaggacacgggacagagggtggccctcgcccaggccagagagggagaagaggaccagccagagtgcccggcgccctacctgcacagagtctaggtggaaatcagaagaggaagtggaaagtgatgacgagtatcttgccctccccgctcggctgacacaggtttctagcctggtttcgtatctaggatccatttctaccttggttaccctgcccactggggatatcaaagggcagagccccttggaagtgtcagacagtgatgggccagcttccttcccttcaagctccagccaaagccagcttccccctggagctgccctccaaggatctggggatcctgagggccagaatccctgtttcctgcgctccttcgtccgtgcccacgactccgcaggggaaggcagtctggggagcagccaggccctcggggtctcctctggactgctgaaaacacgcccctccttgccagctaggttggaccggtggccattctcagacccagatgttgaagggcagcttcccaggaaaggaggagaacagggaaaagaatcactggtgcaatgtgtgaagacattttgctgtcagctggaagagctgatctgctggctgtataatgttgcagatgttactgaccacgggactgcagccaggtccaatcttacaagtctcaagtcttctctgcagctttaccggcaatttaagaaagatatagatgaacatcagtctctgacggagagtgtcttacagaagggggagattcttcttcagtgcctgttggagaacaccccagttttagaggatgtccttgggaggatcgcaaagcagtctggtgagctggagagccacgcagatcgcctgtatgactctatcttggcctctctggacatgctggctggctgcacccttatccctgacaaaaagcccatggcggcaatggagcacccatgtgaaggggtttaacctggcatcttctcaggcagaggtgcaacctgtcggccaaacactggctagtgagaaaaaaaaccttcaagaagtccttgcaagagccattcaacactgaagtcaagggggaaaccttcaatatactagctttaaaatgcctttctcctccctgaatggagggctgagttactatttttatttacaatgaatccttccaaactaaggttttccttttggtgcttctccacaaagagcgtgtagctttgcaatttttgataaaataagacgtgttgccttcccctctatcccattaaaaaagagcagataaagctcaaactattccacctggtagggtcatttaccaagggctggtaggagattccgaatactcaatattctcaggcatgcaagaggacctaagagactgaaaaaagtgaattgttggccagaaaccttgggtcttttcataaaaggaaatttgggcttgtcaatccctctttaaagatataggtagaaagaagagatttttaaccctttgtctgcaaaagaaaaagggttaaatgaagcatctatacagatgactttgggagattatgacaccttttgccatcttcagggcttacgtctttactttcttggctaaccagtttcttagaagaaaatgtgtcagggacttggggatctacagtcatgctttagcatggctatggagctaattatcaagcttaaagggtaactttgggaggactcctcccttcactcctagtctcccttggaagagcagtccaggctcagggaagggaacggataggatgacacagtaagtacagaaactgaagctgtcaatagtgaaggaaaaaggggaattcttcgttgctttggcattgacacataagtactttgattaaaaaaaaaaaaaactatggatcaaccattcaaagcatcaattctatagctttttgcagcaagatgatcagttattgctggtaactgcagattctacagaaaagcacttttaaagttctgttgggccatgaatgaacctggaaggaggaaagcacagtaacaatggaaactaaagtcctattattaatgtgacttttctgcttcagaatttctgagactttatagtcactggaaaatagccattaaattctttaaagattagctcttcaacagtagctacacataaaatgcagtatttcaagtgcctgatgctgctgtggtatgctttatcataatgcttaagggcatgatcaaaattaaaatggcttatgagtttgccatattaatcatcttagttccatacacactgagactttaaaagggaaaaaccactctagcaaataattgtcaattataaacctgtatgtaaaacattcttgaaaacctagagttggttaaaaaggtagagatgtctgacggcctcttcttaaattgatatattttaccttctcttagatgtacatttataagtaggaacatgtccttccactgagtatgttactgaatagcccttaggaaattaaacccatttatttactaatatttgacaggcatagaagtgtattaattagcataaaagttggagatgaaaaccctatagaaacaaattggccaatattatactaattgaatgcagaatgtggcattctattcccattcaactaataatcagcttcaactgacaggaatttgcacagaatgttacacaataccctgtttcccaagaaagtactaccttacctagagatgatctaagatatttttgttcatcctctgaataaggtgagactaaagggtgctaactccctggacctggctgtgaatgctactgaagagtatcaacacaactgttaattataccgccgtgctttaagtttaagacttaccttaaaactcaagctgaaggctgggcacggtggctcatgcctgtaatcccagcactttgggaggccgaggcgggtggatcacaaggtcaggagatcgagaccatcctggctaacacggtgaaaccccatctctactaaaaatacaaaaagaaattagccaggcgtggtgatgggcgcctgtagtcccagctacttgggaggctgaggcatgagaatggcatgaacccgggaggcggagcttgcagtgagctgagatggcaccactgcactccagcctgggcaacagagtgagactcttgtctcaaaaaaaaaaaatcaagctgaaattgtttcagcctagtaagatgctgccagcagcatttctatgagcaaacatggccaaattagagtcaagtagctgagcttgctaactgcactgtgatgccacactggaataacttagtagtcccttaaaattaatggaagttaaatccacagggaagtgatgatactcaaagctggatcagcagtttcaagatctgggttcttggagatccataggtaagctcagcaaatggaagacgacgtcaacacggctattttgaagcttaggtgggaatggaacacaaagaaggtttgaggtaagatatgctggaaaggcaagatgtaggctaagggaaattcaatccaaggtcgaagaataggaaattactgctcagaccacaatgactatcattctgaaaggatttcacagagtgtgcagctgcttagatttaagaacactcttcttcactatgtaaactaatttatggcagcaccttatatttagaacaagtggtaattccctttactaagtgaacagattattaaaacctgtagtagctttgaaccgtttgtacttgaaaatgggggtataaaggggtatatattttttccagaaccacatttattggcgtatacatagaagcaaatcttaaggcatgctgaaatttgttgtaaatcccaatctttactgccatggggaaaagaacgctggaattttccaaacttaagtctgtaaatatgctcatcttaagttcatgtaatgtttccgctaactcaccaagaataagctgacaatttaaacaacttttactgtgtaaaaatgaagtgcacggcatggcatcacagtatcttgacatttgttttgtgtcatttagctactttagaaaatagtttctgaactctttccccctttatactgtattaaggcaaaaacaaaacttctgaagcattaaagatcttcaccaaaataactattggtaacttcaggaatttgtcagttgccttatgtgaggatgaatagatccaccaagcacgcctataatacaaagtaaactatgatttttattgtgaaattttcatagatggaaaattgaatattctgtccatttcattttacaattatcttaccacttatttttgtaccatgtatttcaattgcctgtttagtgaaaaataaaaattaaaaaaaccta

SEQ ID NO: 188 - DNA, 255 bp, Homo sapiens
gaggggaagaggatgtgatcatgcgaccgccagcagaagggaaattgtgaaagcgacctgctgtagaaaaggcggcccacagccacctcagcatgcagaggaggcccagctgctgagaggagttgcctgagagtgacctttgcatctgcctgtccagccagcatggaaccaaagcggatcagagagggctaccttgtgaagaaggggagcgtgttcaatacgtggaaacccatgtgggttgtattgttagaagat

SEQ ID NO: 189 - DNA, 255 bp, Homo sapiens
gccccaggtgcgcttcccctagagagggattttccggtctcgtgggcagaggaacaaccaggaacttgggctcagtctccaccccacagtggggcggatccgtcccggataagacccgctgtctggccctgagtagggtgtgacctccgcagccgcagaggaggagcgcagcccggcctcgaagaacttctgcttgggtggctgaactctgatcttgacctagagtcatggccatggcaaccaaaggaggtactg

SEQ ID NO: 190 - DNA, 255 bp, Homo sapiens
aagagaaggggctgggggcggggagatggtgagtcggggataaacactccgcggcggtggcggctgctgctctgctccgggttctgtcactgtgtcggcggtgcccagctcactggccccctccctctcttgtcgagcgtggttgccagagaggctccctcagccctgctccgcggggtccacagcgggctccacagcgggctccatagcgggctccacagcggtccggcggcggcagcgagcccgtgggcagtg

SEQ ID NO: 191 - DNA, 255 bp, Homo sapiens
gcgcacgcgcaacctaacgcgggactgccagcaacttccgggcgtttacaggcaggcaggtcagtgatgtgtcctaagggtccgaccgacctagatacccctctttgattcctcctcttgggattagtgtccatctctggaagcaggatccaggaggacgggaggggccgctgcggaccgcagtcgctccacctggaggagacaccagaaggaagacagcctgagggacgcagccatccccggctcctaccggcg

SEQ ID NO: 192 - DNA, 255 bp, Homo sapiens
aagggtcataaggcggaggcgcgcccaagatggcggcctccatgtgcgacgtgttctccttctgcgtgggcgtggcgggccgcgcgcgggtctccgtggaagtccgtttcgtgagcagcgccaagggaaaggggctgtttgccacacagctcatccggaagggggagaccatcttcgtagaacggcccctggtggctgcacagtttctctggaatgcactttatcgctaccgagcctgtgaccactgccttaggg

SEQ ID NO: 193 - DNA, 255 bp, Homo sapiens
ggggcctgccacgaggccgcagtataaccgcgtggcccgcgcgcgcgcttccctcccggcgcagtcaccggcgcggtctatggctgcgacttctctaatgtctgctttggctgcccggctgctgcagcccgcgcacagctgctcccttcgccttcgccctttccacctcgcggcagttcggggaatctctccctaggtcaggttggagtgcagtgctgcaatcacggcttactgcagccttgacctcctgggctc

SEQ ID NO: 194 - DNA, 255 bp, Homo sapiens
atttccgggtcactgtagatgcgatggcgccgattccaaagactgtggggcggatcaagctagactgctctctacggcccagctgcccactggaggtcgctgctgcacccaaactttgcaaggaattcggtccagaggattacggcgaagaggacatagtggattttcttcgacggcttgtggagagtgatccccagggcctgcaccggatccatgtggatgggagcagcgggcggctgcagctgtggcaccatg

SEQ ID NO: 195 - DNA, 255 bp, Homo sapiens
gggggcggagccgggcggtgtttcatccctcagcctcaggctgagccggaccgagccgagaggacccgagtggggccgaggccagtagccccggggccctgagcagaggccgtagcttgcgccgcacccgcggccaggcggagccaaagatgccggcctctgctgcgcggccccgcccgggtcccgggcagcctacagcctcgcccttcccgctactgctgctggcggtgctgagcggcccggtatccggccgcg

SEQ ID NO: 196 - DNA, 255 bp, Homo sapiens
gcgggcgccgctcttttgtttcttgctgcagcaacgcgagtgggagcaccaggatctcgggctcggaacgagactgcacggattgttttaagaaaatggcagacaaaccagacatgggggaaatcgccagcttcgataaggccaagctgaagaaaacggagacgcaggagaagaacaccctgccgaccaaagagaccattgagcaggagaagcggagtgaaatttcctaagatcctggaggatttcctacccccg

SEQ ID NO: 197 - DNA, 255 bp, Homo sapiens
ggcattttccggtgcctgcaccaaatcaggaagctcctagtctgtgccccaagatcacgcctcatttggaggtcacacgaggcctggctggtgggtcctgccagggcactggatctggagagtggaggaagcactgggtgccggggtttgggctcggggccatgtacgcctcctcctaccccccacccccgcagctgtcccctagaagccacctttgcccacccccaccccaccccaccccaccccagctcaata

SEQ ID NO: 198 - DNA, 255 bp, Homo sapiens
gtatctgtggtaaacccagtgacacgggggagatgacatacaaaaagggcaggacctgagaaagattaagctgcaggctccctgcccataaaacagggtgtgaaaggcatctcagcggctgccccaccatggctacctgggccctcctgctccttgcagccatgctcctgggcaacccaggtctggtcttctctcgtctgagccctgagtactacgacctggcaagagcccacctgcgtgatgaggagaaatcct

SEQ ID NO: 199 - DNA, 255 bp, Homo sapiens
gacaattacgtctgggtccaagcaaacatgaggcagctgccagccggcctgggcagtcttgtctgcctcggctgtgaagtggggaggctggcaacagttttcttcagcgcccaggatgcagccggctaaggaagtgacaaaggcgtcggacggcagcctcctgggggacctcgggcacacaccacttagcaagaaggagggtatcaagtggcagaggccgaggctcagccgccaggctttgatgagatgctgcct

SEQ ID NO: 200 - DNA, 255 bp, Homo sapiens
agttggctcggcggcagcggagcggccggagctgcggtgcggaccggggccgcgcggcgtggcgcggggagcggcggcggcggcagagccagagcaacatggcgccggtgggcgggggcgggcgcccggtcggcggaccggcccgcgggcgcctcctcctggcggcgccggtgctgctggtgctgctgtgggcgctgggggcccggggccagggcagcccccagcagggcacgatcgtgggcatgaggctggcga

SEQ ID NO: 201 - DNA, 255 bp, Homo sapiens
gaggccgagagggggcagcaggcgatggcggcggcggtagctgcggcgggtcggttaggctggttgttcgccgcgctctgcctgggcaacgccgcgggggaggccgcgccgggcccgcgagtgctgggcttctgcctggaggaggatggagcggcgggcgcgggttgggtacgcggaggggcggcgcgggacacgccggacgccaccttcctcctgcgcctcttcggcccgggcttcgccaacagctcttggtcc

SEQ ID NO: 202 - DNA, 255 bp, Homo sapiens
tgcatgctccagggacggcacccttgtctggggcaggtgcttgtgggggctgaggctgccttgctccccacacccctgcccctgacctgggagtgtaccgctgtgtgtgcccagcacgcataacgtccccagacaaaccgcggccgatgcccatggacacgagcgtgtatgagagcccctacagcgacccagaggagctcaaggacaagaagctcttcctgaagcgcgataacctcctcatagctgacattgaac

SEQ ID NO: 203 - DNA, 255 bp, Homo sapiens
agcatcgcgcgcaaggcctgccggttgctcggggtcgtatgacgcacttttccagctcgagccctcacgaggccgtgggtacgaccggaagccgcagactgaatctcgctctgttgcccagcccatctcggcccactgaaacctccacctcccgggttcaagcgattctcctgcctcagcctcccgagtagctgagattacaggcgcctgccaccacgcccaggcggtgtccctgaagtataaatccaaagcctt

SEQ ID NO: 204 - DNA, 255 bp, Homo sapiens
gctcactcgctcaactcggcgccgccgcggccccacgctccgggcccgtcctcgaggcgcgcggcgcggggcgcgggcgccggggcctgaggcggcgggcgacgcccgggggcctgacggccggccccgcgccatggtgtgagcgccgccgcccgtgcacgctccgtccgccctccgcgcggcccggccggcagagagccccgagcggcccgagagcgcagccgagcccgccgccgccgcccgcggccccgcgag

SEQ ID NO: 205 - DNA, 255 bp, Homo sapiens
cccgtgaggaggaaaaggtgtgtccgctgccacccagtgtgagcgggtgacaccacccggttaggaaatcccagctcccaagagggtataaatccctgctttactgctgagctcctgctggaggtgaaagtctggcctggcagccttccccaggtgagcagcaacaaggccacgtgctgctgggtctcagtcctccacttcccgtgtcctctggaagttgtcaggagcaatgttgcgcttgtacgtgttggtaat

SEQ ID NO: 206 - DNA, 255 bp, Homo sapiens
tagacgcaccctctgaagatggtgactccctcctgagaagctggaccccttggtaaaagacaaggccttctccaagaagaatatgaaagtgttactcagacttatttgtttcatagctctactgatttcttctctggaggctgataaatgcaaggaacgtgaagaaaaaataattttagtgtcatctgcaaatgaaattgatgttcgtccctgtcctcttaacccaaatgaacacaaaggcactataacttggta

SEQ ID NO: 207 - DNA, 255 bp, Homo sapiens
tcaggaggcggagatcgctgcttctcacctactttctgaacttggcctccgcagtcgcgacctggcgtgaaggaggagctgccgcccccgccccagcctcggggacgcctctctgaagagaagccatttgaagcagaatccaaaccatgaattgtagagaattacccttgaccctttgggtgcttatatctgtaagcactgcagaatcttgtacttcacgtccccacattactgtggttgaaggggaacctttct

SEQ ID NO: 208 - DNA, 255 bp, Homo sapiens
agatgcgacgaggttagcggggcccgaccactccttggcttcccaggggtgagcctcgcgagttaggagttgggtagagagtcagcccggggcccggcatccgctttttcgttgaagcaacgactttggccggatgactccccagggtcggcatcagcgtgggactgggaacaggtgaagggaaacagaagagagcctgagaagaccgctctcctccgatcctaattgactgagccaatgagagccaaagaggtc

SEQ ID NO: 209 - DNA, 255 bp, Homo sapiens
gccgggccggaagaagaggtagggcgccgccgtgacagattagtcctaaagggaacggggttgttagttcaattggctaccggaaaaaaccaggctgggctgggcgccgccatgacaaccgataccggaaaaggcgggtcgttccccccggacagccctacgccggcaaaggtctcgagatgcaggcggccctagaggtcaccgctcgctactgtggccgggagctggagcagtatggccagtgtgtggcggcca

SEQ ID NO: 210 - DNA, 255 bp, Homo sapiens
gggcagctccaccctgggagggactgtggcccaggtactgcccgggtgctactttatgggcagcagctcagttgagttagagtctggaagacctcagaagacctcctgtcctatgaggccctccccatggctttagagacgatctgccgaccctctgggagaaaatccagcaagatgcaagccttcagaatctgggatgttaaccagaagaccttctatctgaggaacaaccaactagttgctggatacttgcaa

SEQ ID NO: 211 - DNA, 255 bp, Homo sapiens
caagccgactgtgagccaggaagtgctcttggggagcccaggccaagccatccattcttgggtcctttggagggtagatatggattcccagtttctccagcggccagtgctccccctagtccacacagtgagaccgtgaaagcagatgctccggggcactcctgggcagcttttgctcagtggatgatgggtgactacagactccctgaccacccccagcccatggaaattctcaacctgtacttgggagacagc

SEQ ID NO: 212 - DNA, 255 bp, Homo sapiens
gccgagctgcgcacgtgcggccggaagggaagtaacgtcagcctgagaactgagtagctgtactgtgtggcgccttattctaggcacttgttgggcagaatgtcacacctgccgatgaaactcctgcgtaagaagatcgagaagcggaacctcaaattgcggcagcggaacctaaagtttcagggggcctcaaatctgaccctatcggaaactcaaaatggagatgtatctgaagaaacaatgggaagtagaaag

SEQ ID NO: 213 - DNA, 255 bp, Homo sapiens
gtgggagtggaggaggaagaggcggtagggggtacgggggctggtcccagaagatggcggaggcgggggatttctggtaggtcctactttaggacaagatgtggtaccgttgaagcgtcagtctttgattcacagacagttgagcttttcagctgggaagcctttccatttttttttttttaacggctttctgaacctatgaaaccatggcagaaggagagacagagtcacctgggcccaaaaagtgtggcccat

SEQ ID NO: 214 - DNA, 255 bp, Homo sapiens
ggcgtgctttgcggccgccctgccgcgcgcacatgtaggcgttccgagcggcggcggaggtgagcgcacggacgagcgggagggacccttctccggcctgatgcgacccggtaacgcgttcagactgcggagtagcctaggggcccagagtggaagcgtagcgaggacccctctgcggggctcctgcagcccctcctcccccagccaccggcgggctgcatggtactgtgttctaggcccaccccgcagcgcgat

SEQ ID NO: 215 - DNA, 255 bp, Homo sapiens
cgctcggggggtgggaaagcgagcccggcagctcaatgacaaatcggtggaggacggctggggtccggccccgggagggggcggggcgcgtttaagagctgcgggccgggtgcggacggcggaggcggcgggactggtccctgctcttcagtgggtcatctgtgtgtcacagcctcagaagaccagcgagatggctgccaacaagagtaagggccagagctccttggccctccacaaggtgatcatggttggcag

SEQ ID NO: 216 - DNA, 255 bp, Homo sapiens
atggattaactcgaactccaggctgtcatggcggcaggacggcgaacttgcagtatctccacgacccgcccctacaggtgccagtgcctccagaatgtggcagctcacaagcctcctgctgttcgtggccacctggggaatttccggcacaccagctcctcttgactcagtgttctccagcagcgagcgtgcccaccaggtgctgcggatccgcaaacgtgccaactccttcctggaggagctccgtcacagcag

SEQ ID NO: 217 - DNA, 255 bp, Homo sapiens
aaacgtcctgttgtgtccctcagctccagcccaagccccccacccagcccccgcctgctctgagtctctgagacagtcacacactcagactatgtggccaagctgggggcggggggcatgggctagggacacactagaatattcacgctccggtggcagcagcagcagcagccagaggagcagcccgacacaacaagggacccctcaggaatgaagcagcctttcagggccagaggggctgtggtctcccttcct

SEQ ID NO: 218 - DNA, 255 bp, Homo sapiens
tggaagcggcactcaagatgctgcgccgcgaggcccgcctgcgccgcgagtacctgtaccgcaaggcccgggaggaggcgcagcgctcagcccaggagaggaaggagcggctgcggcgcgcgctggaagaaaaccgcctgattcccactgagttacgccgagaggctctggccttacaggggtccctggagtttgatgatgctggaggtgaaggtgtgaccagccacgtggatgatgaataccgatgggcaggag

SEQ ID NO: 219 - DNA, 255 bp, Homo sapiens
actggcactgctgcctgagccttcctggagttacttaatccaccccagccccaggcactgaaccacgcgtgcagacccctcgtcctcagttctgcggagacagagtccccacagcatttctgctcctccctcaagactgcggcagagcacagcaccagtagaccccacacacagctggggcactggcagcatggagctgaagagaggaaagaccttcatcaagtccagcctgcaggtttcccacgagaaaccccc

SEQ ID NO: 220 - DNA, 255 bp, Homo sapiens
tgagcgtttttttttttttttttttttttttttggtctgggcttccgaatatgttttatgacggttgattttacaccaggaggtttgtctccgaggaagacccagggaactggatatctagcgagaacttcctccggattccccggcgcctcgggaaaatgggagctgctgcaaagttggcgtttgccgtctttcttatctcctgttcttcaggtgctatacttggtagatcagaaactcaggagtgtcttttct

SEQ ID NO: 221 - DNA, 255 bp, Homo sapiens
aaccaaccagccacccgtcagagagggacatgcgcactccagggaaggcactcaaaagtggggggcaggaaagatgtacattgaagatgtcagtttctacatgtgggaagtagacattgaaggctttatggtttacagacaagatctttagaagataagcactaaaggaccaaggaaataaataccagaaatcaagaagagcacacactattttccttcatcaatccatagaaccctaatgcttctttagttcca

SEQ ID NO: 222 - DNA, 255 bp, Homo sapiens
acttcctgagccgggctggctgggtgggaacaggctccttgccgcctccccagcgctggccactaccacactgccgcccgcctgggcctcctttcaacctcgtggtggagccctgcggtttcccagcggagccgggcccggggctgctccctcgcgggcgaggctcacctgtcccggcccggccccctcccgcgccccaggtggttcagggcggggaggagccgcgccccgccccgcgcggtagcagccaacgcc

SEQ ID NO: 223 - DNA, 255 bp, Homo sapiens
gtgcaaaacctggccagcagcccgagtgagtaggagccatgtgactctggtgagttggagtgtgcaattgcctcctgcttcagagctacctgatccgaatactaagcagagcgagtgccgggctgagtgtaagacactgaagacactgcagagcaaggtgcttattccagaggcgttacaaaacatggagattaaagaccagggagcccaaatggagccgctgctgcctacgagaaatgatgaagaagcagttgt

SEQ ID NO: 224 - DNA, 255 bp, Homo sapiens
atggcggcggcggccgcggcggccgtcgggggccagcagccgtcacagcccgagctgcccgcgccggggctggccctagacaaggcggccaccgccgcgcacctcaaggcggccctcagccggccggacaaccgcgcaggtgctgaggagctgcaggcgctgctggagcgggtgctgagcgccgagcggccgctggccgcggctgccggcggcgaggacgcggcggcggccggaggcgggggcggtccgggggcg

SEQ ID NO: 225 - DNA, 255 bp, Homo sapiens
ctgtgcggtcacttccggcccgggagcgcgcgggttgattcgtccttcctcagccgcgggtgatcgtagctcggaaatggcgggatttggtgctatggagaaatttttggtagaatataagagtgcagtggagaagaaactggcagagtacaaatgtaacaccaacacagcaattgaactaaaattagttcgttttcctgaagatcttgaaaatgacattagaactttctttcctgagtatacccatcaactctt

SEQ ID NO: 226 - DNA, 255 bp, Homo sapiens
aacgggctcattcagcggtcgcgagctgcccgcgagggggagcggccggacggagagcgcgacccgtcccgggggtggggccgggcgcagcggcgagaggaggcgaaggtggctgcggtagcagcagcgcggcagcctcggacccagcccggagcgcagggcggccgctgcaggtccccgctcccctccccgtgcgtccgcccatggccgccgccgggcagctgtgcttgctctacctgtcggcggggctcctgt

SEQ ID NO: 227 - DNA, 255 bp, Homo sapiens
actgtcttcctcattggcgccgtgcagagaggcggaatgttcaactcctaactgcggcggaaacgtgggagccgcgcgggccgctgtcgtcccaacccccgccgccctcgtcgcgcgcggggcctccgcgcccccggctgctgctcacgccccgcccgggagccagattttgtggaagtataatactttgtcattatgagatgtcgtctctcggtgcctcctttgtgcaaattaaatttgatgacttgcagtttt

SEQ ID NO: 228 - DNA, 255 bp, Homo sapiens
ctggaggcgcagcacggtcgccgccgccgctgtcggtgctggagatcgcggctcggtgcaggcggcgcccatgcctcctctcctccactagcccgcgcgccagtccgcctgccggggccggctctccgcctcctgcctcccgtcgcagccgcgcagccgccgcagagtccgcggcgccaccgctcgccctccaggttctgccacttgctgggaaaacagcaacagaaggatattaaggagccacccctataattt

SEQ ID NO: 229 - DNA, 255 bp, Homo sapiens
tcgacgtcggggtcaatgaaaacaaacggggagcccagggggaaggaaggcaggcgaggaagaggcagcgccggggcgccggagggagcagccgggctgcggaagcgcgagcaggaggccggtcgcgggcgcatttttgccgttgtcgcggccgccgccgccgaggcttacccgggaatgtctgggcccgcgcctcgcggcccccaagctccacgctgcgcccgctgtcccggcctctaaaggccgccacgtccc

SEQ ID NO: 230 - DNA, 255 bp, Homo sapiens
ggcgcgcacgcgcagctccgcttccgggagccgctcctcgctacccactatgctctgcgacatcgacctgtcgcaaaggccgcgtttgcggggccaatgagcgactcgctttccgtgcggtgcggcgagtgaggccccggtcttcctcctcgtcctgccgcagggccagaacccctgacggtattcagctgcgcgtaagtctggccggtgccatctgtctccgcaatgccccccaagaaacaggctcaggccggg

SEQ ID NO: 231 - DNA, 255 bp, Homo sapiens
ggctgagttttatgacgggcccggtgctgaagggcagggaacaacttgatggtgctactttgaactgcttttcttttctcctttttgcacaaagagtctcatgtctgatatttagacatgatgagctttgtgcaaaaggggagctggctacttctcgctctgcttcatcccactattattttggcacaacaggaagctgttgaaggaggatgttcccatcttggtcagtcctatgcggatagagatgtctggaag

SEQ ID NO: 232 - DNA, 255 bp, Homo sapiens
agtgcggagccttaggcggagcgaagagaaccggtcgcggcaatcctagcgcgcagcagcagcagcagcagcagcagcagcagcagcagcagcagcagcacccgcatccgctgcgggagtccgagccggaaccacacccaagtagctgccctttcctcttctgtcatctcaccgccccaccacagaccgcgttccccgaggaaaccggccgcccacgcccggagcatcctcccctgttgagcgggcgctgacgga

SEQ ID NO: 233 - DNA, 255 bp, Homo sapiens
agtcgctgtttgggacgctgggtgtgcggtgttctgtctccgctcccgtttcgctgtcacagcccgttccttcccggagcccgggacaggctgggcgcgcgcccgtgtgagtgagcgggactcagggcagaagtgtcccctcactgcgtttttttttccttttatccaaagaacggggcagttagtacgcttgccttcctgtcgcccggttgggagcggggttggtgtgcggagtggttcgcctttttttcttta

SEQ ID NO: 234 - DNA, 255 bp, Homo sapiens
ggcggtgctgcagggctggtccgggaggtgacgaccggcttcggagagtctatcatggcagctcggactggtcatacggccttgagaagggtagtctcgggatgccgtccgaagtcggcgacagcggccggggcgcaggcgcccgtgcggaatggcagatatttagcttcctgtggtatactgatgagcagaactcttccactacatacctcaattttgcctaaggagatatgtgcacgaactttcttcaaaatc

SEQ ID NO: 235 - DNA, 255 bp, Homo sapiens
attggctttccggccggaagctgcggcgcgacccggctgcgcatgcgcctctcacacgtgctgtcagaacgccgcctcctccgcttgcggccggtctgcaccatgctgcgaacgtccgtcctccgcctgctaggacgcacgggggctagtaggctgtctctcctggaggacttcggcccacgctactacagttcgggctccctcagtgccggcgatgatgcttgtgatgtgcgcgcctacttcactacacccatt

SEQ ID NO: 236 - DNA, 255 bp, Homo sapiens
atactcagtcacacaagccatagcaggaaacagcgagcttgcagcctcaccgacgagtctcaactaaaagggactcccggagctaggggtggggactcggcctcacacagtgagtgccggctattggacttttgtccagtgacagctgagacaacaaggaccacgggaggaggtgtaggagagaagcgccgcgaacagcgatcgcccagcaccaagtccgcttccaggctttcggtttctttgcctccatcttgg

SEQ ID NO: 237 - DNA, 255 bp, Homo sapiens
gcagcgtgttctgattctttgcgggacggcgagcgcatttgtgctttgcccgccgcggcctaggaggccttttgaggccgcgtagtcggtgtttttgaactgactctacagcttctggcaggccgtgcggcgccctgacccggcctcaccatgttggtgctgtttgaaacgtctgtgggttacgccatctttaaggttctaaatgagaagaaacttcaagaggttgatagtttatggaaagaatttgaaactcca

SEQ ID NO: 238 - DNA, 255 bp, Homo sapiens
gggggggaccatgtcccagcgggtgaggcgcaatgggtcccccacgccggccggctcccttgggggtggtgcggtggccacggccgggggacccgggagccgcttgcagcccatgagggcgacggttccgttccagctgaagcagcagcagcagcagcaacatggcagccccacgcggagcggcggcggcggcggcggcaacaacaacggtggctgctgtggtggcgcctcaggccccgcaggcggcggcggcgg

SEQ ID NO: 239 - DNA, 255 bp, Homo sapiens
ttttttttgtagagactggggtctcactatgttgcccacgctggtctcaaactcctgggctcaagcgatcctcccgcttcagcctcccaaggtgctgggattacaggtggagccaccgcgcccggcatcgataatctgaatctctaacgagctcccgggcgacgttgatgcagctggtaccgggaccactcttcgaaaatcatcggtttagaggttttaattctgaatccattgcgaaaactgttgggcggacag

SEQ ID NO: 240 - DNA, 255 bp, Homo sapiens
taaagttaggacctgaatgggttacgttgcgatacacgatcaaacatcgcccttataagctctgtggtatccccgagccccactcctgtatgcagggaaattagtcattctccttggtaaactttcttcaagtaagtccttcagctacagccgcgaacatatgctttttgacctttgagggaatccgtaagatctcgtgagaagcgcagcttctcggggaagctgtcatggctgctcctgtacgtagtcacggtc

SEQ ID NO: 241 - DNA, 255 bp, Homo sapiens
caaccatgtaagcagcttcgcttcctgccgcaaccgtccgcggcctgaggagcccaccgccgctctcgggggccgacttccgggggctgagccgttgaagcggaggctggggcggggggcagccggcgcggccggggcaggaggcgcagactcatgaaatggccacagatgataagacgtccccaacactggactctgctaatgatttgcctcgatctcctactagtccttctcatctcacacactttaaacctt

SEQ ID NO: 242 - DNA, 255 bp, Homo sapiens
cacagaccgggtagaggcaggcccacagcatgtcctccaaggtttactccacaggctccagagctaaggaccaccagccctcgggtccggagtgtctgccactcccagaggccaatgctgaagccatcgacttcctcagctccctccacaaggaggagctacagatgctgttcttctctgagacgctggccatggtctcagacaccggggagcctcagggagagctgaccattgaggtgcagagagggaaatacc

SEQ ID NO: 243 - DNA, 255 bp, Homo sapiens
acagaacacggggtgcctggaaggggaacagatgtgttgtggggcacagggcaggctgggaggggaacaaaggtccactccatgggtaaccagacccttccgccagggctggccacttctgcctttggaaaatgtttcacaacgccccatgttgtgtgtgtgtgtgaatcggccgatgtgaaccgaatgttgatgtaagaggcagggcactcggctgcggatgggtaacagggcgtgggctggcacacttacttg

SEQ ID NO: 244 - DNA, 255 bp, Homo sapiens
gggaaggtggcggcggcggcggcggttgtcccggctgtgccggttggtgtggcccgtcagcccgcgtaccacagcgcccgggccgcgtcgagcccagtacagccaagccgctgcggccgggtccggcgcgggcggcgcgcgcagacggagggcggcggccgcggccagggcggcccgtgggaccgcgggcccccggcgcagcgctgcccggctcccggccctgccggcctcctcccttggcgccgcggccatggc

SEQ ID NO: 245 - DNA, 255 bp, Homo sapiens
actgcagagagctgaggcaccatgcatgggggccaggggccgctgctcctcctgctgctgctggctgtctgcctgggggcccagggccggaaccaggaggagcgcctgctcgcagacctgatgcaaaactacgaccccaacctgcggcccgcggaacgagactcggatgtggtcaatgtcagcctgaagctaaccctcaccaacctcatctccctgaacgagcgagaggaagccctcaccaccaatgtctggata

SEQ ID NO: 246 - DNA, 255 bp, Homo sapiens
agttctgcctctgtccaggtccttgtgacccgcccgctctcctaagggagcgtgtcctggccccctcccgcagcggctcggaaaaaaggcagcaccgcgtcgttgacggcgcgggctctggactcgctgcttggtaaaaaccttcctcttcctccagtgcgggacgcactctctggtatctcttttgacctcccggaggctttcctttgtcggtcgcggcgccactgtactatggcatacctcgttttattacgc

SEQ ID NO: 247 - DNA, 255 bp, Homo sapiens
aagaaaatcctgcttgacaaaaaccgtcacttaggaaaagatgtcctttcgggcagccaggctcagcatgaggaacagaaggaatgacactctggacagcacccggaccctgtactccagcgcgtctcggagcacagacttgtcttacagtgaaagcgacttggtgaattttattcaagcaaattttaagaaacgagaatgtgtcttctttaccaaagattccaaggccacggagaatgtgtgcaagtgtggcta

SEQ ID NO: 248 - DNA, 255 bp, Homo sapiens
cgggccggggcggcgcgagcggctggagcaacgggccccgcggcagctgcgggcgacgcggtcgatggacatgggcacccagggatcggggcgcaagcggctccccaaccgggagcggctcacggcggaggacgacgcgctcaaccagatcgcgcgggaggcggaagcccggctcgctgcaaaacgggcggcccgcgcggaggctcgcgagatccgcatgaaggagctggagcggcagcagaaggagatctatca

SEQ ID NO: 249 - DNA, 255 bp, Homo sapiens
tcacctgccccacagccgcaccctgcctgtgcctgcaccctggggagcccagagccggcaggggccgaggcggtgggacctcgggggagctcaagcctcgactgtcccctcgctggaggccagaggccaagatgatgtccatgctgggcggcttgcagagatacttccgggtcatcctcctcctcctcctggccctgactctgctcctgctggccggattcctgcactcggacttagagctggacacacccctgt

SEQ ID NO: 250 - DNA, 255 bp, Homo sapiens
ggcagatctcacgagagaggatttggcgccctcctctgtggattctggccaggccgggttcggcggttgctgtgagagcgggcttcccaacaccatgccgtccgccttctctgtcagctctttccccgtcagcatcccagccgtgctcacgcagacggactggactgagccctggctcatggggctggccaccttccacgcgctctgcgtgctcctcacctgcttgtcctcccgaagctacagactacagatcgg

SEQ ID NO: 251 - DNA, 255 bp, Homo sapiens
atccagtacgtggcacacattgctcagaaaagccccttgtgcccgctttctgccatccgcgctgtctcgtgtctccctttttccattaaatgcctcttttcttgcgggtctcatctcgggaatagtgcactacggggacatacctatccccaactatcctaggcccgagaaccagcccttgccttcgcgtaacaggcggagactcgctgaggcgagttgcacttctaattgggcgtgaggtcttgtcaatcccca

SEQ ID NO: 252 - DNA, 255 bp, Homo sapiens
cgagtctcgctcaggctcggttttaccccggagtctattcgaagggggctgctacgtcagcgcgtctcagcgtaagacggcgctattccgctgtaacagcttccggcgggtcctggatgttgatgtcctgcatctaacgcggtgtaacccccgaagccgagcgagctccggaggaatttcagtatctgctacggtaacttcatcagcccgccaagatggcgatgcaagcggccaagagggcgaacattcgacttc

SEQ ID NO: 253 - DNA, 255 bp, Homo sapiens
aacggctcctttctcttctcttagcagcacccagcttgcccacccatgctcaagatgggcgggatgccagcctgttacataaatgtgccaaaagcctggccatgcctggaaaatggaccaatccgcccgccaagaggttgggtctcgttccctagagagaaggaagtttcctctccttgaagtgagagctagaatcgcactttctgtcaagctgagagaaagactcttttccagaggctaaaaggacaagaaaat

SEQ ID NO: 254 - DNA, 255 bp, Homo sapiens
aaaaaaaaaaaaaaaaagaagctcttatgccaggaacctggaatggagaccaaatatatattggttatatcatagtatcacagggttactttggcatttgggaaacttgagagaaatgggcaataactgttactttaaaagcttgggtgctgtgattctgccttcagcctcagccacttttgtggtgctttgcgtggcatcagtacctccactgattcttctgtctttcctctctctcttccccccctctttccc

SEQ ID NO: 255 - DNA, 255 bp, Homo sapiens
tcttccttgcggaaatttgcatcgtgggcttgtagggactgcttcactgagccatggtctgttcggctgccccactgctgctcctggccacaactcttcccctgctggggtcaccagttgcccaagcatcccaacctggacagagtcaggctggaggggaatctggatctgggcagctcctggaccaagagaatggagcaggggaatcagcgctggtctccgtctatgtacatctggactttccagataagacct

SEQ ID NO: 256 - DNA, 255 bp, Homo sapiens
gcggaagttcctaggccagcctgtcacgtgggagggaggctcggcgctcaggaagcatggcactctggcgggcataccagcgggccctggccgctcacccgtggaaagtacaggtcctgacagctgggtccctgatgggcctgggtgacattatctcacagcagctggtggagaggcggggtctgcaggaacaccagagaggccggactctgaccatggtgtccctgggctgtggctttgtgggccctgtggtag

SEQ ID NO: 257 - DNA, 255 bp, Homo sapiens
agttgctaaggaaatgactgcccgcagcgcctggccccgccgcgcaggccgggcggggtctggagcggcgccgtttccgcttccgctccctcacagctcccgtcccgttaccgcctcctggccggcctcgcgcctttcaccggcaccttgcgtcggtcgcgccgcggggcctgctcctgccgcgcgcacccccggggcttcggctccggcacgggtcgcgcccagctttcctgcacctgaggccgccggccagcc

SEQ ID NO: 258 - DNA, 255 bp, Homo sapiens
aagcccctggctgtttatactccggagggtgtccccgtgcgtcatcggtggagtggaccaaaactggtgatctgtttgccctgtgtgaccttgcccagaaccctgctgactgagagaacacatctgctggaagtcctctgggattcaaggtacagggaatgaagagtagttttacagaaaaaagaggacaatattgggatcacctttgacctttccatttggaaataatattttctattgtgttatagaaaggtg

SEQ ID NO: 259 - DNA, 255 bp, Homo sapiens
cgcgcccaccggagcccgggctgagagggacctggggagctgcggcctggccggggcggcgcactcaggtggcctcgcttccctgcgggtcaccgcccgccactcgcacagctaggtcggcctgttgggatcgggagaggtgggcgcacgagttttagtgcgggagtccggggtgcgggcggagtcctattgtccccgtgcacccgggcggcagcacctccgggtccctctttaaaccgagcgtccggcgacctt

SEQ ID NO: 260 - DNA, 255 bp, Homo sapiens
ggattcgatcctgcgcgacggccgcgaaggcgggggcggaggctcggcctgcgcggctgggagcggcttaggggaggagggaagaccggaagccacggttgcgtccccatccttagattcgctcctccgggcagggagcggagacggaggaggaggagggagaggctgaatgttggctcgggagacgtacgaggaggaccgggagtacgagagccaggccaagcgtctcaagaccgaggagggggagatcgacta

SEQ ID NO: 261 - DNA, 255 bp, Homo sapiens
cttctctggggcggtcgcgttggcagcggatgcgggaagccggactctgggcgtcatgtactacaagtttagtggcttcacgcagaagttggcaggagcatgggcttcggaggcctatagcccgcagggattaaagcctgtggtttccacagaagcaccacctatcatatttgccacaccaactaaactgacctccgattccacagtgtatgattatgctgggaaaaacaaagttccagagctacaaaagttttt

SEQ ID NO: 262 - DNA, 255 bp, Homo sapiens
gcggcgcggagggaggtgagcggcgcgcgcggagccggcgggcgaggaggaggactgcacagaggccccgcccccgccgccgcgagccggctcttcgccgcctccgaacccgctcactttgcctctcgcctctggacggcggcggggcggccgccggattcgcggccgcagggagcgccggagacggggagctattccgccccggcggctccattcggcgcccgcagccctcagggggtcggccccgcggcttgg

SEQ ID NO: 263 - DNA, 255 bp, Homo sapiens
ctcgtttgcgatgttccgttatctggatgcggcggagggatctggcggagggaggtgtttatgaggcgctgggggcggaggaggcgaattagtccgagtggagagagcgagctgagtggttgtgtggtcgcgtctcggaaaccggtagcgcttgcagcatggctgaccaactgactgaagagcagattgcagaattcaaagaagctttttcactatttgacaaagatggtgatggaactataacaacaaaggaat

SEQ ID NO: 264 - DNA, 255 bp, Homo sapiens
ttttttttttttttttgcttaaaaaaaagccatgacggctctcccacaattcatcttccctgcgccatctttgtattatttctaatttattttggatgtcaaaaggcactgatgaagatattttctctggagtctccttctttctaacccggctctcccgatgtgaaccgagccgtcgtccgcccgccgccgccgccgccgccgccgccgcccgccccgcagcccaccatgtctcgccgcaagcaaggcaaaccc

SEQ ID NO: 265 - DNA, 255 bp, Homo sapiens
gggccgcggcaggagcagcgggagctacagcatcagcaagagcaacagtagctacagccccggcggcggtgcctgttccagtctttgctgctgcagtccgtgcaaccacccagagggggaggggggaaccaccagtcgctgaggaacaagagaaggggggaaagtttaggcgagccttgggggggggggccagcgccggagccgcgtgagagagggagccgtgttttggtaggggggagtcggactgcaactggc

SEQ ID NO: 266 - DNA, 255 bp, Homo sapiens
ctggactcagtgacttcagacacagaagtctgtccatggctccttatcacatccgcaaataccaggagagcgaccgcaagtcggtcgtgggcttgctctcccgggggatggccgaacacgccccagccaccttccggcgattactgaagctgcctcgaaccctcatactcttacttgggggggcccttgccctactcctggtctctggctcctggattctggccctcgtgttcagcctcagcctccttcctgccc

SEQ ID NO: 267 - DNA, 255 bp, Homo sapiens
agtaagccagcgtggctacgccatcacgaccggcggtggcacatgcgcaatagcgagacgctggagcgcggcgtaggtggctgccgagtcttttcctgtttagggtcttatcctggcattgagggcgccggactggcgcttttggccgacttggcattgggtgggcggcttcttgggacccacatgagccagtggcatcatccccgcagtggctggggccggagacgcgacttttcaggacgctcctcagccaag

SEQ ID NO: 268 - DNA, 255 bp, Homo sapiens
acttccggcgggaggcggaggcggaggcgcaggcgctggctggcaggtgtcgctaaccggacggtggtcgccagggcgagaggcgggagccggagaggtgaggcaggacccgggctccactgccgcctctccgagctcttgtgacgcggacctcagtgccaggatggctcggggcgagcggcggcgccgcgcagtgccggcagagggagtgcggacagccgagagggcggctcggggaggccccgggcgacggga

SEQ ID NO: 269 - DNA, 255 bp, Homo sapiens
gaacccgtttcttttccttccccagtgcgtctttcctgcgtcgttccggcgcggcgggagcagagatctgcggccgtttgcagcttgcggtagggaggcgtggtggtctgaagcctccgagcagccgcggccatggcggatgtaaccgcccgtagtctgcaatacgagtacaaggcgaactcgaatcttgtgctccaagctgaccgttctctcattgaccggacccgccgggatgaacccacaggagaggtgctg

SEQ ID NO: 270 - DNA, 255 bp, Homo sapiens
ggcagagaggccgcggagggctggcgggcgagcgcgggcaggcggcgacgcgggggcaggggtggacggcggtcagagccgaacgcgagggcggcgcccggggactggagctgcgcgcaataggacagctggcctgaagctcagagccggggcgtgcgccatggccccacactgggctgtctggctgctggcagcaaggctgtggggcctgggcattggggctgaggtgtggtggaaccttgtgccgcgtaagac

SEQ ID NO: 271 - DNA, 255 bp, Homo sapiens
agcatcgcgcgcaaggcctgccggttgctcggggtcgtatgacgcacttttccagctcgagccctcacgaggccgtgggtacgaccggaagccgcagactgaatctcgctctgttgcccagcccatctcggcccactgaaacctccacctcccgggttcaagcgattctcctgcctcagcctcccgagtagctgagattacaggcgcctgccaccacgcccagcatgctgatcccattttcaatgaagaattgct

SEQ ID NO: 272 - DNA, 255 bp, Homo sapiens
accaggcaacaccattgaaggctcatatgtaaaaatccatgccttcctttctcccaatctccattcccaaacttagccactggcttctggctgaggccttacgcatacctcccggggcttgcacacaccttcttctacagaagacacaccttgggcatatcctacagaagaccaggcttctctctggtccttggtagagggctactttactgtaacagggccagggtggagagttctctcctgaagctccatccc

SEQ ID NO: 273 - DNA, 255 bp, Homo sapiens
agaactagtccgctcggcgcccagagcctcgcattacttcccctagctccgccaagcctcgctgcatacgcgcccgcgcgcagtccgccgtcgcgcccctatgacgtcacccacgcgccaccgcttccgggctggggactgggggcggggccgcgcggagggcaagccgggggcggggccggggccagagcagatctccgggcctccgcggccatagctgactgtgccgtcccttcccctcacccgctccacgcc

SEQ ID NO: 274 - DNA, 255 bp, Homo sapiens
atgctctgcccggctgcggcgcttcgggcaggcggcggcggcggcggcggcggcggcagagggagtttccgctttgtactccaccccggtagcagctccgcggcagggacagcttcctccggacgcttggcgggcttcgctctcgccttacgacagcccggtcggatcatggggttgcccagggggccggagggccagggtctcccggaggtggaaacaagagaagatgaagaacaaaatgtcaagttgactgaa

SEQ ID NO: 275 - DNA, 8098 bp, Homo sapiens
tttttttttttttaatccccgcaccaagcgcttaacctcattggggtggaggagaaggcggcggctctctggtccgcagcggcaacagtaacgaaaaacagggctaatggactgctgaattatgaagtatttcagacccagtagtagaacatcactctgccactcactcctttatctcctactagttatttaaattggacttttaatatcctaccagctgctcttcagacacacatggtgcattgttgccattccccagattgcatctttgaaacacaggctcttagtaaccttcagcgaacaaagaggcaacctcccagatacgtctgctgggagggagtcatcgtgactgccctctagcttttgctggatctggatttgaattccactatggagcctcgcatggagtcctgcctggcgcaggtgttgcagaaggatgtggggaaacgattgcaggttggccaagaactgatagactatttctcagacaaacagaagtctgctgaccttgagcatgaccagaccatgttagataaacttgtggatggacttgctacctcttgggtgaactctagcaattacaaggtggttctgctgggcatggacatcctgtccgccctggtgacccggctgcaggatcggttcaaggcgcagatcggcacagtgctgccaagtctaatagacagactaggagatgctaaagactctgtgagggagcaggaccaaactctgctgctaaagatcatggatcaagctgctaatccccagtacgtatgggacagaatgcttggaggcttcaaacacaagaatttccgtactcgagaaggcatctgtctctgccttatagcaacactcaatgcctctggagcacagactttaacactaagcaagattgtgccacatatatgcaacttacttggagatccaaacagccaggttcgagatgcagcaataaacagcttagtggaaatttacagacatgtaggagaacgtgtgagggcagatctcagtaaaaaaggattgccacagtcccggttgaatgtaatttttacaaaatttgatgaagtccagaaatctggaaacatgatacaatctgcaaatgataaaaatttcgacgatgaagattctgtggatggtaacagaccttcctctgctagttctacatcatccaaggctccaccaagttctcggagaaacgttggaatgggaaccacccgccggcttggttcatccacccttggatccaagtcttcagctgcaaaagaaggagctggtgctgttgatgaagaggattttattaaagcatttgatgatgtacctgtagtacagatttattccagccgagaccttgaggaatccataaacaaaattagggaaatattatctgatgacaagcatgattgggagcagagagtaaatgctctaaaaaagattagatctttacttttggctggtgctgctgagtatgataacttctttcaacatttgcgtcttttggatggagcctttaaactctctgctaaggacctgcggtctcaggtagtgcgggaggcttgtatcacgttggggcatctgtcatcagttctggggaataagtttgaccatggagctgaagccattatgccaactatctttaatttaattccaaacagtgccaaaattatggccacatctggtgttgtagctgttaggttaattattcggcacacacacatccctaggttaatacctgtcataacaagcaactgtacctctaagtctgtcgcagttagaaggcgctgttttgaatttttagatttgcttttacaagaatggcagacacattcactagaacgacacatatcagtattagctgaaacaataaagaagggaatacatgatgctgattccgaagcaagaatagaagccagaaaatgttactggggtttccacagtcacttcagcagagaagcagagcacttgtaccacaccttggagtcctcctaccagaaagccctgcagtcccacctgaagaactcagacagcatagtgtctctgcctcagtcagaccgctcatcttccagctctcaagagagtctaaatcgtccgctgtctgccaaaagaagtcctactggaagtaccacatctagagcttctacagttagtaccaaatctgtgtcaacgactgggtccctccagcgatctcgaagtgatattgatgtgaacgcagcagccagtgccaaatccaaagtctcctcatcttcgggcacgacgcctttcagctctgcagcagctttgcctccagggtcatacgcatccttaggtcggatccgcacaagacggcaaagctctgggagtgccaccaacgtcgcctctacacctgataaccggggccgcagtcgcgctaaagtggtttcacagtcccagcgatccagatctgctaatcctgctggtgctggcagccggtcaagttccccaggaaaattgttgggaagtggttatggtggacttactgggggctcctcacgaggcccacctgtgacaccgtcttcagaaaagcgaagcaagattcccaggagccagggatgtagccgggaaacaagtccaaaccgaataggattagcacggagcagccgtatccctcgacccagcatgagtcaggggtgcagccgcgataccagccgtgagagcagccgagatacaagccctgctcggggctttcctccacttgatcggtttgggcttggccagccaggaagaatacctggttctgtgaatgccatgagagttctgagcacaagtacagatcttgaagctgctgttgctgatgctttgaagaagcctgtgaggaggagatatgagccgtatgggatgtattctgacgatgatgccaacagtgatgcctcaagtgtttgctctgagcgctcatatggctccaggaatggtggcattccccattatctgcggcagactgaggatgtagcagaagttctcaaccactgtgctagttcaaactggtcagaaaggaaagaagggcttctgggcctgcagaacttactgaagagccaaagaacactgagtcgagttgaactgaaaaggttgtgtgagatcttcactcggatgtttgctgaccctcatagcaagagagttttcagtatgtttttggagactcttgtggattttataataattcataaggatgatttacaagactggctttttgttcttctcacacaattacttaagaaaatgggagcagatttacttggatctgtgcaagcaaaagttcaaaaggctctagatgtcacaagggactcctttccatttgatcaacaatttaacattttgatgagatttattgtggatcaaactcaaactccaaacctcaaggtcaaagttgcaatcctgaaatacattgagtctctggccagacagatggatccaacagattttgtaaactctagtgagacaaggcttgctgtttctagaatcataacctggacaacagaaccaaagagttcagacgtgagaaaggcagcacagattgtgctaatctctctgtttgaattgaatactcctgaatttaccatgttacttggtgccttgccaaaaacattccaggatggtgccaccaaactcctgcacaaccacctcaagaattccagtaacaccagtgtgggctctccaagcaatacgattggccggacgccctcccgacacaccagcagcaggaccagccccctgacctcacccaccaactgttcccatgggggtctgtctccaagtcggttatggggttggagtgccgacgggttagcgaagcacccacctcccttttctcagcctaactccatccccaccgctccctcccacaaggctctcaggcgctcttactctcccagcatgctggactatgatacagagaacctgaactctgaagaaatctatagttctctacgtggagttacagaagccattgaaaagtttagttttcgaagccaagaagatctgaatgagccaattaaacgagatggcaaaaaggagtgtgatattgtgtcccgcgatgggggcgctgcctcccctgccactgagggccgggggggtagtgaagtagaaggaggccggacagctctggataacaagacctcactactcaacacccagcctccgcgcgccttcccggggccgcgggcgcgagactacaacccgtacccctactcagatgccatcaacacctacgacaagaccgccctgaaagaggctgtgttcgatgacgacatggagcagcttcgagacgtgcccatcgaccattctgacctggtggctgaccttctgaaagagctgtccaaccacaatgagcgagtggaggaacggaagggagccctgctggagctgctcaagatcacgcgggaagacagccttggtgtctgggaggagcacttcaagaccattctgctcctgctgctggagacccttggagacaaagaccattcaattcgagcactggcgttaagagttttgagggaaattctgagaaatcaaccagcaagatttaaaaactacgccgagctgacgattatgaagactctggaagcccacaaagactcccataaggaggtggtgagagcggctgaggaggctgcgtccacactggccagttccatccacccggagcagtgcatcaaggtgctctgccccatcatccagacggccgactaccccatcaaccttgctgccatcaagatgcagaccaaagtcgtcgagaggatcgcaaaggagtcattgctgcagctccttgtcgacatcatcccaggcttgctgcagggttatgacaacaccgaaagtagtgtgcgtaaggccagcgtgttttgcttagtggcaatttattccgtaatcggagaagacctgaaacctcaccttgcacagctcacagggagcaagatgaagctactaaacttatacataaagagggcccagaccaccaacagcaacagcagctcctcctccgatgtctccacgcacagctaatggcagtacctgtctcttgtgtagacctagaagcaatcggtggtgcctctcagagacctttccccacccccttcatcggctgcccagtcagtacaaggaggcccacaaatatttattacaatcagtattttggtcccttccagcttttctgtagaatcttactggtattgaatgtaaaggaagcaaggcctgtattgcagtcttcatacaaaacaaaaggaataagaacagaaaagagccatactgaaacatgtcttgtacagcctgctgagatggcgaaaccctgtgtgtggggtgcagtttttaaaaatcagagcgctctagccactacttggtagaaagtagcattttttttttcagttaataacatatttgggggtggggtggggtgttactttgtgttcttcctccttagcctattttcttgtgcgtatggtctgtgtggggcccctttcacagctgacaccacgaaaggtgatatatctttaagttgtgttctgagacctactaaaaatgggaatcaagtcttggcaagaacagtctgaagatggccttttaacaaacgctgggaattttgcttgtcatatccagactggaggccgactgccctggctttcagcgtagaattgggagtgcaccctgacagtctccttccagctctccctaatcgactccaccgacaaggtccctaccccagagcttccatgcaaaggaattcttcaagtttaaatctggacacaaaaataagataaatgtatggcatcatttagggatgcctgagatggcagttcatgaagcacagaagataaagaagaagtctttcatctttactgctgagatccttgggaacactgttgtcatgggggctctgccaagaccctcatctctgggctacacggtgattcagattgagcaccaacttgtttcctcccctcaaagttctgcctaagccgttcagttctaacatggtctcagttaatctggtaaatggcatctttaccatcttagttctgacttctcagtttaatgtgggattaagagccaagaaaagcctagagagactggatatcacaattttttttaattttataaactgaagtagttccttgaatgtctgttgatgaaatagtcactgtttaaggaaaaaagtaattatgaggtgtagcagattgcagaaaaacaggattagaaacacacttaaaaagaacacacatttagagtctctcttcctcctcagcgaaccactaggccccctttttaaaaacacctttagagcctaattactccaataaaagtaactagaggtttggagtctggttaaataaattctgagtaaaattcttaagccaaatggaaattcttaatgcaatcatgaggacttctattgtctcttactgttgtattagatcctataaattgaactgatttttccataaggaaaatgcttcttttgagattaattctaataacgtatttgctattgcagtgcagagcccactgcaactgctaggactgaaagcagaggctgggtgccagagcacgtgattcttaacatcatttccacagacccctctgccctgaccctctgcattggatgcaggaagctgggaaagactgatgttgatttggaaacatgggctgaaaatgaaggccccatagtgcataggaacagtaaagccagggtgctgacgtgtgtgtgtgtgtgtgtgtgtgtgtgtgtgtgtgtgtggtgttgtgtgtgtttgtgcgtgcaccctacacatgtgtggtacctcactgctgctgtttagggaacttgagggacgcgtttcaaggggttgggtattactgacgagctttggctcaaaatatagcaggaccaggtcttttgttgataagtactgtttgtttattaatatgtcattaatggtatttcttttttacactctacaagtgaattagggagtctcttgttgacccctttgttgcaggaatgtgcgtcgggctaggttatccatgagtttctttattcctaatgcagttagaaagacctttctccttgagctctttgactcccagaaggtaccccagtccccagtgtacttagaaaggatctcgaacattgctggacgtcctcatagtactcacaaagggctagccttgaatgtcactcgcccagtcttcagtctcctgacttagagatacaatcacgtcacaggtctcttggcctcaatctgaaaactgctgccgccgcgccgaggagactcgcatgccgccaccacctcactgggagggcgccgagcccaccgtcgccccctagaccctgacagctgcagctgccttgccttgccgccgcctccctgcagggcccctgttccaatgaaaaacagaacacaaaagagcagagcacctaagcctgtctctgcctccctgtctaccggactggccagggcccaagacccccgctgctccactgcggggctgggcgggctgactccctgcttcctccaagctgctgcctcccctgcagccagggtctgggcagggtgcagccggtcctcggggcacgcagcttccttcaagtacactgtgtgtgcttcccggacctgcggcgatgccacgggcctgccttttctatgcgcctcactagcttaccaccctgtgcaggtaatgcaactgactttgtctcatcagtctttttctttccctgccaccctttatttatcaagcgtaatgttacactttaaaggacagcaaataagaactttgtagaatcccaccaggactttgctaacaataatgtttggaaataaagaagtgctctgaaaaaatatcagccaccaaaatagttatgttggcactgtgttcacacgcatggtccccacacccccaggttgggtgggtttttttgttttttgggtttttttgggggggggggctttttcatgttacatccatatctgtatttatatcttatttgtttcactttcaagtgtatcatggcaaatgtacagatttttttgttaataatgtgctaggatttgctaaaaaagaaaaaaaaaaaacccttttgagtttgccctagaataaatgagacttaattcaaaaaaaa

SEQ ID NO: 276 - DNA, 255 bp, Homo sapiens
aagaggactgcgagcacagcggcggccgggtggcgggggtgagtggggccagcggggctggacagcagcgggccccgggcgccgccgccgcgatccctccccgcgcccgccgagcacatcgccgccgccgagatgggccctccgcggcacccccaggccggcgagatagaagcgggcggtgcgggcggcgggcggcggctacaggtggaaatgagttctcaacagtttcctcggttaggagccccttctaccggg

SEQ ID NO: 277 - DNA, 255 bp, Homo sapiens
ttcaaagaaacagcagcttttggacattttaatgagttctatgccaaaaccagaaagacatgctgagtcattgcttgacatttgtcatgatacaaactcttctccaactgatttgatgacagttaccaaaaatcaaaacatcatcttgcaaagcatcagcagaagtgaggagttcgaccaagatggtgactgcagtcattccacactggttaatgaagaagaagatcccagtggtggtagacaggactggcaacc

SEQ ID NO: 278 - DNA, 255 bp, Homo sapiens
ggacttgctggagatatagaaagggacctgacacagtttctggccttaaggagctctcattccagtggggaagaaaaaaactaaaataatgatgtccgagagcatcagaaaagaacctgctctggtcaggtatctctgcattagccagattggacatatgtaaagggacatcagtatatctggatcatcagattgtgcttcaagaagaccatagggaagaacgcattttcatcttgctgcaaaagttgcaataga

SEQ ID NO: 279 - DNA, 255 bp, Homo sapiens
gcatgccgggagtggttgtgtacggtccgcagcggcaggtgaagtctagcagaggacgcggccaggcgattcggtgaagcgattcctgcaggcgttggttcccctctttgacctggaagcctggagccagaggacttttggtggctgaggccttagctacctggcttacacattaaggaggacacagatttgcttgctgtctgtctgtcaaggcctggctcagctaaggacctgttaacatttctagagaagaaa

SEQ ID NO: 280 - DNA, 255 bp, Homo sapiens
gctgacgcgcgctgacgcgcggagactttaggtgcatgttggcagcggcagcgcaagccacataaacaaaggcacattggcggccagggccagtccgcccggcggctcgcgcacggctccgcggtcccttttgcctgtccagccggccgcctgtccctgctccctccctccgtgaggtgtccgggttcccttcgcccagctctcccacccctacccgaccccggcgcccgggctcccagagggaactgcacttcg

SEQ ID NO: 281 - DNA, 255 bp, Homo sapiens
ctttcactggcaagagacggagtcctgggtttcagttccagttgcctgcggtgggctgtgtgagtttgccaaagtcccctgccctctctgggtctcggttccctcgcctgtccacgtgaggttggaggagctgaacgccgacgtcatttttagctaagagggagcagggtccccgagtcgccggcccagggtctgcgcatccgaggccgcgcgccctttcccctcccccacggctcctccgggccccgcactctg

SEQ ID NO: 282 - DNA, 255 bp, Homo sapiens
gcaggcgcggaagtggggcctcgcccctgccgacgtcgcaggctggagctcacctgggagactccaagtggaagccgagcctcggttctgcctctccaggcaacgcgggaggcccagcgggaaggcaggaggcggcggcggaggaggagctctactgagccgcaactgtggcgacagcaaccggagtcgcagccgccgccacctgcacctggcgcctagcccacgtccagcgcctgcccggccgccgcttcccgc

SEQ ID NO: 283 - DNA, 255 bp, Homo sapiens
caggtcctccaccatgtgaatgccaacatggccaggtcattagagctgagggaaaactagtgcccaaagatatgaaaagagtgtggatcttctggagaagtgctgttgttcaacaggtacaaaattggaaatgttggcttcaccagaacctaagggccttgttcccttcactaaagagtcttttgaacttataaaacagcatattgctaaaacacataatgaagaccatgaagaagaagacttaaagccaactcc

SEQ ID NO: 284 - DNA, 255 bp, Homo sapiens
gttgggaaagagcagcctgggcggcaggggcggtggctggagctcggtaaagctcgtgggaccccattgggggaatttgatccaaggaagcggtgattgccgggggaggagaagctcccagatccttgtgtccacttgcagcgggggaggcggagacggcggagcgggccttttggcgtccactgcgcggctgcaccctgccccatcctgccgggatcatggtctgcggcagcccgggagggatgctgctgctgc

SEQ ID NO: 285 - DNA, 255 bp, Homo sapiens
gaacggcgatgccccagacgcggctgcagttttcaaaccgcgactgcaagcttcggtagtcctctccgctgctgtcgccaggagtcacttcacgagaagccaggtcacaaccgtcggcccttgtctggaaaagtaaaagtggatcctgccacgttcggagctccctggcgcctcgcccggctggagctagagaactcgtcctgtggcggcccccggcgtggggcgggacagcggccccctggagggggcagtccc

SEQ ID NO: 286 - DNA, 255 bp, Homo sapiens
gtgcatgacccgccccgcggcggagacgcgctcgctgcgtcatcagtgttttcgagacgagtctcgacgcagcagctgtcagctccattttgttgttggtgcgcgacgcagtcagctgcgtgattcccgtgattgcgttacaagctttgtctccttcgacttggagtctttgtccaggacgatgagacactcaaagagaacttactgtcctgattgggatgacaaggattgggattatggaaaatggaggagcag

SEQ ID NO: 287 - DNA, 255 bp, Homo sapiens
gagattttatcgggagcagtgaggtgactttggcagctaacaggccactagtatcctactaaagcttttgtctggataggagcaacatgcatgtttacagtcttgcagtgtgctgagagctggtggccagtgggactgagtgagctgtgtgccgtgtattgacccgcttcctagtcctgaattcctttcagaagctccggcagggaggatgatacagtcagacaaaggagcagatccaccagacaagaaggacat

SEQ ID NO: 288 - DNA, 255 bp, Homo sapiens
ctcttcttgtacagccccggcagccctgccttcttggctggagagtatattcagggatttccccttaataatcaccgaccctgggagcactttttagtttccaaaataaaaatatgatcctcacccctcttgcttgacagggaaaggctctcgccggagcccaggggggagcagtagcagcggcagccgagcttcctagtccattgccagcgcctctcactctgatctgtcagcccagccgagggaacagggggg

SEQ ID NO: 289 - DNA, 255 bp, Homo sapiens
agagaagcgatcgcgagagaaaaaaatgcaacctcccaaaataaagagcaaagattgcattaggagcgaacagcgctgcagaaatagatggcagcttcgtgtcagtgagtttgcatcccccttcctgatccacgagctggagtgattagagccctggaagggaattgttactcccgtggagaagtccccttttcctggcagtcgtctgcactgtacacgctggatgcctctctccatccaccccactcactcgct

SEQ ID NO: 290 - DNA, 255 bp, Homo sapiens
cacttccagggtcggggagacggaactgcggcgaccatgtatttctggtttatcaaaccgctaacacccagtctaagggcaggttctgtcccattgttatcactatcgaagcagccgatggaggaggggaggtctgagcagagggcggggtgcaggcggaatggccctcgtgccctatgaggagaccacggaatttgggttgcagaaattccacaagcctcttgcaactttttcctttgcaaaccacacgatcca

SEQ ID NO: 291 - DNA, 255 bp, Homo sapiens
agcttttccaggacaggacgaagtttttggctgtgggctctctgggacagagtggagcgcctgtggatttagccggggacacaccatcctgctcgcaggtgcctggacaggacaggggacgagggaggaacactctctgaggaagcccaactcctatgagctcctctctggcagcactcaaaccagtgaagcttgggaaagtcattgacctccagtcgttctgctgagaaacatctggctctatttccatggaga

SEQ ID NO: 292 - DNA, 255 bp, Homo sapiens
gtgaggctgccgagcggacagcgactcccggggaagcccgcgctccgggagcgggagcgggagcaggagcaggagcagcgccgtcccaggccagaggcgagcgccgggcgccgggagagcggagagcccgggcagctgccggagcgcgggggcgcggcccgaggaaaccacagagcgagcccaggcctggggagggcgccgaacatctgaggcggcttcgcgggagacaaagccgcgcgtagagacgcgatgccc

SEQ ID NO: 293 - DNA, 255 bp, Homo sapiens
atcagcccaggatctgaccctggactggctcacactcagttgcctctggccagtgcagggctcagccagggatggcttctagctgacagtgggaggaattaattcatctgaccggaatattcttttctcttctgggctgttggtttttcaagtgcaacaaagattccatacagctccaaggaaggagccaagaaaaacattctgtgccaaagtgagatcctggaagtgaaaccccggaataaagctgaaaaacgg

SEQ ID NO: 294 - DNA, 255 bp, Homo sapiens
ggagcgtcccggcttctcccgcgcggggggcgagtaagccagcggcaggaccagcgggcgggggcccacgacaaaagctggcaggctgacagaggcggcctcaggacggaccttctggctactgaccgttttgctgctaccacttataaccacctggttaagtcgagatttggaggtggtttagtttggggcctggatgcaccttgcagagagagaccgctggctttttgtagcaactgtcatgatgcattttgt

SEQ ID NO: 295 - DNA, 255 bp, Homo sapiens
aaagcggggcgcaccgcgggcgccggcaacgagccggtgaacgaggcgaggcccgtgcgcccgcggctgcaagcgcccgcctggcggggagaggggccgacggcgtcagcccgggcggcggcatccctaggcgcctggggcgccttcctccggacctggccgctcgctgccccgccctctgcaccccacttctccgaccctccttcccagtcctgcctccccctgccctggcctctgagagccgactgagcccag

SEQ ID NO: 296 - DNA, 255 bp, Homo sapiens
gctcagagactcacgcagccccagtcccgccagtccgccaacacagtagtgccggcccccctctttccctggccctgccccccctccccgcctttggctcgctccgcctttctgccccccacccccacctcacgggtacgggccattcccggccaggaaacgccgtggcgccgcgttgggcctaactcgagtcctgccgcctcccgggagtgccgtgcgccgcagcccgggcccaggccccggcagcgcctggga

SEQ ID NO: 297 - DNA, 255 bp, Homo sapiens
gcccctggctagagaagccgcagcccgcagtgtccgacccagtcgtcccgcgccggagccggccccgtagcgtgccatggcctgctacatctaccagctgccctcctgggtgctggacgacctgtgccgcaacatggacgcgctcagcgagtgggactggatggagttcgcctcctacgtgatcacagacctgacccagctgcggaagatcaagtccatggagcgggtgcagggtgtgagcatcacgcgggagct

SEQ ID NO: 298 - DNA, 255 bp, Homo sapiens
tgagtagggggcctgcagtgtgctgtgacgcctgggaaggggattctaagccatttcccatcagccgtttactaagtagcctggggatcttgttaaaatgcagatcctgatagattagggctggggtgctgcccaagattctacatttctaagagtccctggatgacggtggcattcacagaccacagcttctatgtgagggagagcagttgggtttctgtctgcctgccgcacctgatcagtagttagtgcctg

SEQ ID NO: 299 - DNA, 255 bp, Homo sapiens
aagaaaggtaagggccctgggcgaggaaagcgcggccctttccgagtttggtgttttgcagcgaaaggaaatctcgctcttccgaaagtcctccagggcgagagaggaaagggcctaggtactgtgctggggtcgcacagccggccgagacagtgccgggacggggagccaggcttccgagtgcgcccggtcactgactcctccgcgctttcctcgtgcgcctgcagcccttggttcttggaaacgccggcgcct

SEQ ID NO: 300 - DNA, 255 bp, Homo sapiens
ccgctcccacctcggcgtctcgtctctcgcccgctgccccgcgagcccgcggcccccgggctcccgccatccgccgacaccgggagcccgggctccccgcgccctgccctccgcgccgggggccgcccgccgcagacacgggacccgcttcgaggccgctttggcgccaaatcctgaggtaacacgtacacagacctctcggccggaatctccagggatgaccagcccctccccacgcatccagataatctccac

SEQ ID NO: 301 - DNA, 255 bp, Homo sapiens
aggaggaggaggcggcggcggaggagtggtgtgtgtgcgagcgtgtgtggctgggggaagccattgcctgtttaatagttgctgttgctgcacttccgcttctctcccagcgagagagagacacgagtggccaggcccagccgcagccgcagcagcagccgccgcggcggcacggaggagccagacacaaagagaggggctgtttgcggggtggggtggggggttcgctatgtcggatgacgattcgagggccag

SEQ ID NO: 302 - DNA, 255 bp, Homo sapiens
gggagaaagggatgaggatgttggataagcagctcagcatgttccccaacatgtaagggaatcaggtcgagttctacactctccttcttggtacacatcctcagaatgcaggaagtgcctgtgcttgctgtgagtctttgtggacagaggcaggatcatgctggctagaatctagtggacaagggcagcacattccccctgttcccaggtgggtccagagatgtcgcctgggagccagggcctggagttctgtta

SEQ ID NO: 303 - DNA, 255 bp, Homo sapiens
cacagtgacgcgcagcccgcgcaggcgcagctacccggcaccccctccccgcggccggcagcccgctcggtattatgattagcgctgggtgcggggtttcggcggccgggagggagttgtcggcgccgcggccgctgcggacggacgctcgcctgccggctgaggaaaaagaagcaactaacaaaacactgtgataataaggattattcagtatgcagtttgcaggatatccatgacgacattgaaaatgaattt

SEQ ID NO: 304 - DNA, 255 bp, Homo sapiens
agtattctcggctcggccattattctgtgcctcggctgccggaagggctcgttcctgtgtcatctcctagcggcctggcgccgaggcggcggtacgcaaggctggagccgcagcgggagcccccgatgatactctccaagctgtaaggaagaagtcaaggattaaggagacctggactggagaggagcctttttcaaaaaacaacaatgacaagagaaaatgtagcccacaatgctctgagacaagagggccttg

SEQ ID NO: 305 - DNA, 255 bp, Homo sapiens
agtagctctgactcctgtcccaggttatgctgagtcccagcagggaaccaccacagctctgaatcagcctgttagccgctgtccattgctcttcatctgctctttatctgaaaatcttcagaagctttccttcaaatgagatgaccacagcagtcttctctgcaggttgcaggaaatgagaggtgctggggagtcagggaagagcaccatcgtcaagcagatgaagatcatccacgaggatggctactccgagga

SEQ ID NO: 306 - DNA, 255 bp, Homo sapiens
cagaagaaggcagcgcccaaggcgcatgcgcagcggtcactcccgctgtatattaaggcgccggcgatcgcggcctgaggctgctcccggacaagggcaacgagcgtttcgtttggacttctcgacttgagtgcccgcctccttcgccgccgcctctgcagtcctcagcgcagttatgcccagttcttcccgctgtggggacacgaccacggaggaatccttgcttcagggactcgggaccctgctggacccctt

SEQ ID NO: 307 - DNA, 255 bp, Homo sapiens
tcgcacttccgtgtgccgcggcgccggagcccgaggcggctgtagcccacatctcccgagcgacccccggcgcccgcccgccgcgcggaggcccgggccacacctcactggccgcttggcccatcccagtcagcgccgcgccgaaccccgtccgcgcgcgccggggagcggcgcccccgccgctgccgccgcgacccttggcgcctgcccctgcaacgggaggtctgcagggaactggccaggcaagggggcagg

SEQ ID NO: 308 - DNA, 255 bp, Homo sapiens
agaataagggcagggaccgcggctcctacctcttggtgatccccttccccattccgcccccgcctcaacgcccagcacagtgccctgcacacagtagtcgctcaataaatgttcgtggatgatgatgatgatgatgatgaaaaaaatgcagcatcaacggcagcagcaagcggaccacgcgaacgaggcaaactatgcaagaggcaccagacttcctctttctggtgaaggaccaacttctcagccgaatagctc

SEQ ID NO: 309 - DNA, 255 bp, Homo sapiens
ctacctcgcgtccctaggcggcggcggccgggcgtcccgggatggccttcatggagaagccgccagccggcaaggtgctgctggacgacacggtgccgctgacagcagccatcgaggcgagccagagcctgcagtcccacacgattgttagaagatacagtgactttgatttgcttaacaacagcttacagattgcaggcctaagtctacctcttcctcccaaaaaattgattggtaacatggatcgtgaattca

SEQ ID NO: 310 - DNA, 255 bp, Homo sapiens
acatgttacttcctgtatggaggcatggccagtttccagccccgcgctcttcgttccttcccagcctgcgccggagccacaactttcaggagcatggactgaaggcgccctcgccccagcgcccctctgagatcctttgtgttttcctccgtttcctccggccgtttctattttggggggctctccgctccccctgcctctcccctccccttcccctctcgcaaacatgcctccttccttcccggggccctggaa

SEQ ID NO: 311 - DNA, 7227 bp, Homo sapiens
gaaaaagggtgaaagagaaacttggcgacctcccggaggagttcgcgaagcgaccaggagcgtgttgccatcgtcctcacccggcacccaattccaccacagagtcgggatttcgtcggtgatcgtgatggggtgcttttatttttctctttgattttcaaaaaatgtctatgtgactgtccctatcttaaggggaagttgaaagtgggggcgggggtgctcaatgagaaacgttgccttgtgtgtagttgtttggagcacactgcaaattatattggcatctctttccaaaagtcactttgattcaacttcgatagctttctcgtaaatggcacgtttaggtggtgagaggtggatgaggaaacaggcaccagtgcagctgatttgacctccagtgggatagatacgattagcaccaggatcgtgtctcattttgaacccagatctgaacagaattaagacgaacgagctttcacaattgcagcagatgaagatccattggtaaattgatcaggatttttggcctaccctccaaagaaaaggagcggaaagaatgtcggagcgggccgcggatgacgtcaggggggagccgcgccgcgcggcggcggcggcgggcggagcagcggccgcggccgcccggcagcagcagcagcagcagcagcagcagcagccgccgcctccgcagccccagcggcagcagcacccgccaccgccgccacggcgcacacggccggaggacggcgggcccggcgccgcctccacctcggccgccgcaatggcgacggtcggggagcgcaggcctctgcccagtcctgaagtgatgctgggacagtcgtggaatctgtgggttgaggcttccaaacttcctgggaaggacgggacagaattggacgaaagtttcaaggagtttgggaaaaaccgcgaagtcatggggctctgtcgggaagacatgccaatatttggtttctgtccagcccatgatgatttctacttggtggtgtgtaacgactgtaatcaggttgtcaaaccgcaggcatttcaatcacattatgaaagaagacatagctcatccagcaagccgcctttggccgttcctcccacttcagtattttccttcttcccttctctgtccaaaagcaaaggaggcagtgcaagtggaagcaaccgttcttccagtggaggtgttcttagcgcatcctcatcaagttccaagttgttgaaatcacccaaagagaaactgcagctcagggggaacaccaggccaatgcatcccattcagcaaagtagagttccccatggtagaatcatgacaccctctgtgaaagtggaaaagattcatccgaaaatggatggcacactactgaaatctgcggtggggccaacctgtcctgctactgtgagttccttagtcaagcctggccttaactgcccctcaataccaaagccaaccttgccttcacctggacagattctgaatggcaaagggcttcctgcaccgcccactctggaaaagaaacctgaagacaattccaataataggaaatttttaaataagagattatcagaaagagagtttgatcctgacatccactgtggggttattgatctcgacaccaagaagccctgcacccggtctttgacatgcaagacacattccttaacccagcgcagggctgtccagggtagaagaaaacgatttgatgtgttattagccgagcacaaaaacaaaaccagggaaaaggaattgattcgccatccggactctcagcaaccaccgcagcctctcagggacccgcatcccgcccctcctagaacgtcacaggagccgcaccaaaaccctcacggagtgattccttccgaatcaaagccttttgtagctagtaaacctaaacctcacacccccagtcttccaaggcctccaggctgccctgctcagcaaggtgggagtgcccccattgaccctcctccagtccatgaatctccacaccctcccctgcctgccactgagccagcttctcggttatccagtgaggagggcgaaggcgatgacaaagaagagtctgttgaaaaactggactgtcattattcaggtcatcatcctcagccagcatctttttgcacatttgggagccggcagataggaagaggctattacgtgtttgactccaggtggaatcgacttcgctgcgccctcaacctcatggtggagaagcatctgaatgcacagctatggaagaaaatcccaccagtgcccagtaccacctcacccatctccacacgtattcctcaccggacaaactctgtgccgacatcacaatgtggagtcagctatctggcagcagccaccgtctctacatccccagtcctgctctcatctacctgcatctccccaaatagcaaatcggtaccagctcatggaaccacactaaatgcacagcctgctgcttcaggggcgatggatcctgtgtgcagtatgcaatccagacaagtgtcctcttcatcctcatccccttccacgccctctggcctttcctcggttccttcctcccccatgtccaggaaacctcagaaattgaaatccagcaaatctttgaggcccaaggagtcttctggtaacagcactaactgtcaaaatgccagtagcagtaccagtggcggctcaggaaagaaacgcaaaaacagttccccactgttggttcactcttcctcctcctcttcctcctcctcctcttcttctcattccatggagtcttttaggaaaaactgtgtggctcactctgggcctccctacccctcaacggtaacatcttcccatagcatcggcctcaactgtgtgacgaataaagcaaatgcggtgaacgtccggcatgaccagtcagggaggggcccccccaccgggagccctgctgaatccatcaagaggatgagtgtgatggtgaacagcagtgattctactctttctcttgggccattcattcaccagtccaatgaactgcctgtcaactcccacggcagtttttcccactcacacactcctctagacaaactcataggaaagaaaagaaagtgctcacccagctcgagcagcatcaacaacagcagcagcaaacccacaaaggttgccaaagtgccagccgtgaacaatgtccacatgaaacacacaggcaccatcccaggggcacaaggactgatgaacagttccctccttcatcagccaaaggcacgtccctgacagctgaaaatagcacggggaggaataatgcggacacttttgaggacaagttacacctccactcagcactctggactccacgatgcctttgagtctgttttcccaacctcctgtgggcctcaagggtagaaacctgccgggctgttgttttaacgaggatttccctgaagctatgtctctagcagtgagtactcataaaggacactggatcaagttcagccaccgaattgcttttatcagtgttaaagtggtctgaactgcttgctaccaatctgtgagaagtttttgtttttgttttgttttttaacttgcagtatatcacagagccactcttcaagtagattggctgggcaaaagaatgttttggcaagagcgttactgtagacctttctccctccttccttttactaccatttttttttaacactgtcatctgtaggtcactctccagcagttaggcaccttaactggagaccagaaaccttccagagaacacagggctgcatcccgagcaaccctctgaagaagggaattaggctttagattttgatagcaatgttccaggaatgaaatatagatgttagcccaagacaccatgacaaaatagcccagccttttgagagtaatttgggaaaagaagctgtcagaagtttctaacttacaaactggtttgaaatttttgatgcccagacagcaagtataaatcattttggaggcttacttttcatgatacaaaagcaattctgtgtgatttttttttttaagaagaaagaaaatgcaagctagttttgagaaaggaaggccaaattgggtcgggggagggtgggagtgaggaagttaaaatcactatagggagaaaaaacttttttcaagatttccaaagagatgaaattttcttaatccttttaagttttcatagtaaacagtatggcagattgggttggttgtcctacctggtctatttttaaaagtcaccttttaaagtgacattattagatacacttaaatgtttccaaggcactctctacattacccttgtttttctctttggatactgtcctgggactaagtgtagatttctgcttcaagcacttctggcattgtgtgtttttgtatgcactccccttcatgccacttcagatgtttatttggatgtggttggggacgagagcagacaccaaggaaagggagttggagagaatgtaagtcctgacctgaaggtcttttgtgatgcatgtataggattgccctgacacacaccctcctttcttgggattataccagccatcttcctgagagttttggagccctctaggatattttttctagtaccccaccccccacccctaaagaaagaccttaatatgttaaaacagcattgcttggagaaggtgtcattgaattccgggacgagccggagcctttaaatgggtgcttccaccactacaggctcctgacacgagtaacaggcactgttgcttagaagaacacacgaagttgccgaacacagggtaaaatttccaaggcgctgatcgttgccctggccagggcctgatgagagccagtcagtacattctttttttcctacagttcttgggtttcaaacttcagtttcagggaatttcaagtcaacaacaggtagaatgaataaacttggttaccagcctaataatgtgaattgctacagaattattcttattatgtaagaaaacaaaaactttatgcagatactttagctataaattgatgtaaaatactgatttttttaaaggaaggagagaacagtatcttgttcaattattatgcaatcaatcagtaaatgtttttaaaatgatactacaggagagcttagtaaggagagggcatggatgggccagtttggcatagttgggagaaatcagtctggtttccatcccagtcggggaagagagaggtgagagggaatcagaacgtacctagttgattccttggtgacaagtgcaatggggtatgggtagaatttattttcagagccaagaggacttgatggttataaataaagttgcctttagcaatggaatttacagatcgatcatgttgttccgaaagatgtgaataggatccacaataacaagttgattcagactaatgtagatatttagattagcaagtattgaacatttgatttcttagactgaggttttaaatgaatttcattatttctcccggtaatacacagagcatcgggattaggaaattagccattttggattctgtctgccacaaacagacctattctaaacagtgctattaaattttagactgttgttcaaatattttattttctcctaaactactttttatggtgatgaataattaagaccatttaaaacacgggagtacaagtatttttttgaattaaattaacttgcaaaaaccaaatttgcagtggttgggttgtttctagacagactttggtatcaatttaaaaccaagataatttttatattctttccaatagaatttcatgacaactcctgcagttttcttaacctacaaaaaaaaaaaaaaagtgctgcaatgatgaacaaagaattatacaaaacctacttttgtatctttattttggaatttcttgttctattataaatatggaagtatccctatttcagaagacatattttgttaaaaatgaattgtacatatttaaatatgtatttttgcacaggtctttttttctgatatcctgttttggtacaattgagatcatctagtatttatttattaattaataaaagtaaatacctttttataatttgaagtggttcactgccaagccaatagttctagaacctgcctcctttacagttttaagggatgcctctgttctgtgaaaagtctttgtcccttttagtgtctcgggagtggattcatacagatgaagtgggcattgcttcttcctggttgcctggtttcccgatagactacatgtaactaagtgacacactgcttttcttttgttagtattttatgtgtgggagtatgtgactgcgtgtgtgtgtgcctgtgcgtgtgtgtgtatactcagcacatgtatgttactatgtgatgtggtttaaaactaatggaaaaaactgaaagtgcctgaaactagttttaagcttagacagaatctctttaaaaagacttgaatgttcagttgaacttttggagtttgctttttccacctaaatattgtttctaaaattttaggggcggagttgaaaaccaccaatgctggtaattttataaggtattttaaaattaagacctcttggttcatagtaattcaattggtgatggattgcctggtggcaccaagggttacagatctttttgtcagccagcaacttacacgatgtgtccgttttgttattcactcatgaaatacaatttaaaatatttaaaatattttgtattccaaaaatataatacaaagaagtacctctgagaacattgaaaaaaatgtataatttgaaaaatgtaacttataagggcagctgtcttcctgcaagagttctgttgccaaggaatttcttaatgtcgctcattctgtccagggggtttggggcgattgggctttgaaaaaatattcttaaaagtttgtttagcagaaaataatcacttttacattttgtgcaaaacattttacattttcagataatttaaatgagcactacatactgtcagtgtgaatgtagggccttgaaagcattttgcttttttttttttttttttttttttgagcttggttataaaagcaatctcctgtgttaaaaacgtgtgaatagtttgataatttgtacacataatcaagagcatctcagctggactttgtgttggctgctgtatagaacatgaacaaatgtcaagggatagaaaattactttggatatttaaaagagaagaaatatatagtctatttgttttgtaacaagtttctgtaaataaaataatttatactatttataagaaaa

SEQ ID NO: 312 - DNA, 255 bp, Homo sapiens
ataagccgcttctcccctccttccggaagcgtaacactgaacgtgcctgcgcaatgggtgtcgggtccgctttttcccaatccggacgtaatcgtggtttttgttctgcaataggcggcttagagggaggggctttttcgcctatacctactgtagcttctccacgtatggaccctaaaggctactgctgctactacggggctagacagttactgtctcagctctaggatgtgcgttcttccactagaagctctt

SEQ ID NO: 313 - DNA, 255 bp, Homo sapiens
aagctattgaagctgacacccacagagttaaactcagttgctgaagccaccagctccccctcccagtccttcttttcagagtaggctggcagctgtcctaactgcctactaaagccaaatgcttgaggagagagagagagtaaggagccagccatgaatcctttccagaaaaatgagtccaaggaaactcttttttcacctgtctccattgaagaggtaccacctcgaccacctagccctccaaagaagccatct

SEQ ID NO: 314 - DNA, 255 bp, Homo sapiens
atggagccggtcagcacgggcgcggaggccggcatggagggcgcgggaggtgacccgtaccggcgacctgcgcggcgcacgcagtggctgctgagcgccctggcgcaccactacgggctggaccgcggcgtggagaacgagatcgtggtgctggccaccggcctggaccagtacctgcaggaggtcttccaccacctggactgccgcggcgccggccgtctgccccgcgccgacttccgagcgctctgcgctgtg

SEQ ID NO: 315 - DNA, 255 bp, Homo sapiens
gagccggcggcgggaggagctagggctggagcctctccagcctcccgcgaaggtttgagcacaaaatgaacataattagggaaaataaggatctggcatgtttctacacaacaaaacattcatggagggggaagtataagcgtgtcttttcagttggaactcatgcgattactacatataatcccaataccttagaagtaacaaatcagtggccttatggagacatttgcagcatcagccctgttggaaaaggac

SEQ ID NO: 316 - DNA, 255 bp, Homo sapiens
agaattgcgctgtccacttgtcgtgtggctctgtgtcgacactgtgcgccaccatggccgtgactgcctgtcagggcttggggttcgtggtttcactgattgggattgcgggcatcattgctgccacctgcatggaccagtggagcacccaagacttgtacaacaaccccgtaacagctgttttcaactaccaggggctgtggcgctcctgtgtccgagagagctctggcttcaccgagtgccggggctacttca

SEQ ID NO: 317 - DNA, 255 bp, Homo sapiens
ggagacgcgggacccggagccccgcgggccaccgcccctgccggccgcgcagctgggaggatgcggacggcagcgagagcgtgcgcggccacgtgacggccgctataagagcgcacggggcagacgctcggttccccgccgtgcctcctcgctggccgcgctccctcccggtgccggcttctctgagtcaccaacctgaggctgccccggccgcctgcgcacccggcagcaccatgacagatcaggcctttgtga

SEQ ID NO: 318 - DNA, 255 bp, Homo sapiens
tgcgcagtggggagcagctcgctcctgggctttgggctggctgcagtctgtctgagggcggccgaagtggctggctcatttaagatgaggcttctgctgcttctcctagtggcggcgtctgcgatggtccggagcgaggcctcggccaatctgggcggcgtgcccagcaagagattaaagatgcagtacgccacggggccgctgctcaagttccagatttgtgtttcctgaggttataggcgggtgtttgaggag

SEQ ID NO: 319 - DNA, 255 bp, Homo sapiens
ccaactctcattcatttcgccggttaacatgagagatcatggccgccttcgggcttctcagctatgagcagagaccgctgaagcgcccccggctcgggccgcccgacgtctacccacaggaccccaagcagaaggaggatgaacttactgctgtgaatgtaaagcaaggcttcaataatcagccagccttcactggagatgaacatggctcagccagaaatattgtaattaacccatcaaagattggagcttatt

SEQ ID NO: 320 - DNA, 255 bp, Homo sapiens
ggaagccctcgcccagtagaggctgtgggagagagcgcgatgggccgcggcggtgggcgcacgttccgcggggactcatgccacgcgcgtcccggcccgacgcgcaattagcagccacctccgcagcccgccgccaccgcctccctgccctcccgggctgccgcagctaggagctccagccgtcgcctcgcgcaggctgcgggcattgtcctctcggttcgccgcccgggctgctgctgccgccgcggactgctg

SEQ ID NO: 321 - DNA, 255 bp, Homo sapiens
ggcttcaggagagaggcccgcggtgctgtgctgccgggcctcggcgcagagccccggcagagcgccagacgctgactgccggcaccagaatgctcgcgatgaggaagacaggcggagcgctgcgagctagcgagccctcagctctcgtatccatgacgcctgctgcttcgggggacccctggcatgctggggagtgggtctctgtggtacatcctgtaccgccctggccggcgccggacccccatggccccagaa

SEQ ID NO: 322 - DNA, 255 bp, Homo sapiens
gcactccgctcctttcctgcgtcaccgctacacatgcgccttgcaaggaagggcgagatttcgggggcagggcggggggcgggcctaggccggggtctcacagcgactgcgcggacgggttcctgagtggaacatggcgacttgcgccgaaatcctgcggagcgagttccccgaaattgacggacaagtcttcgactacgtgaccggcgtcttgcacagcggcagcgcggacttcgagtctgtggatgacctggt

SEQ ID NO: 323 - DNA, 255 bp, Homo sapiens
aggtagtgcgcgtgcgtgaggctagagcagtgggtgcggtcacgtgggccggcggtccacggccggaatggcagcaagctcagagataatcattcaggtcttcgtgagctaaggccaaacaaacaaaaaacacttgctttgatggactgaatactgttattagaagtaaatatggaaaatgaaccagaccatgaaaatgtggaacagagcctctgtgccaagacgagcgaagaagagctgaataagtctttcaat

SEQ ID NO: 324 - DNA, 255 bp, Homo sapiens
aattgcgtgtgtttcagaaagtctgtataaaattctctgcagtggcagatcatagcaagggatggtttaacaaaatgaaggcactcattgcagcactgcttttgatcacattgcagtattcgtgtgccgtgagtcccactgactgcagtgctgttgagccggaggctgagaaagctctagacctgatcaataaaaggcgacgggatggctaccttttccaattgctgcggattgctgatgcccacttggacagag

SEQ ID NO: 325 - DNA, 255 bp, Homo sapiens
gctgtcttttcagtcgggcgctgagtggtttttcggatcatgtctggtggctccgcggattataacagagaacatggcggcccagagggaatggaccccgatggtgtcatcgagagcaactggaatgagattgttgataactttgatgatatgaatttaaaggagtctctccttcgtggcatctatgcttacggttttgagaagccttccgctattcagcagagagctattattccctgtattaaagggtatgat

SEQ ID NO: 326 - DNA, 255 bp, Homo sapiens
gtcacttttatttgggggtgtggacagctgctttcccaggggagtacttcttacagtgggatttcaagacaagatcggcctgaagaaaaattatatttgtatattttttaaaaagtgggaactttgaggctcagagacagagcagaagacagaacctggtcttctgattccctgtgttctgcttttttcattgttccactggacgctcatcagagggaagatctttttcctcaattgattccaacaatgtctcac

SEQ ID NO: 327 - DNA, 255 bp, Homo sapiens
ggaaagactatgttttaggtgacccgtgtggcctttttgttgaggcctttaggatacaaggcccccacctaaagacgcgaccctcccgtaggaggggggcagggcccgggggcgggagcacagcggggccccagcctcaggcggcgcgtcactgagcacaaaggagacaacagcgaggcggcagcgggcgctgatcttcgctcgccagccactcgcaattgcggttacagacctgcagctccccctcccccagcc

SEQ ID NO: 328 - DNA, 255 bp, Homo sapiens
agatgctcgcctccgcgcgtttccgcttccgccatcgcggacgcagcctcgtgccgggagtcgccgcattgtggtccgcttctctgcactatgtcgggtggcctcctgaaggcgctgcgcagcgactcctacgtggagctgagccagtaccgggaccagcacttccggggtgacaatgaagaacaagaaaaattactgaagaaaagctgtacgttatatgttggaaatctttctttttacacaactgaagaacaa

SEQ ID NO: 329 - DNA, 255 bp, Homo sapiens
accatctatgctccgagcggggtagagagcccttacgaacgcttgggccttccggaagttttccacctagggctgtctcggtatttttaaattcttgcactcgagtcactatttaagctcctccaggaatgggtgcagcttccctttgtgccttcggccttcttgtcacctttgccacagcctcccccaggtatgcaatggtacagcccagcttcagattgggcaccaaattaggacaagccgaagcggacgagc

SEQ ID NO: 330 - DNA, 255 bp, Homo sapiens
gcgcgttgctgcccggaggctcctacgccacggcccgtcgggcccggcgccggaagtgagctgttccgaggcgccgccgggagctgccacgtccgagacctggagcagccaccgccgcaatcatgacttcggggacctggtttttagagagtctagaatctgatgagagaacctgtgcttacttggtgtgtacctcttgaactgctttgcagccatcctcttccactgtctgcctttctgaaatcacaagtcaaa

SEQ ID NO: 331 - DNA, 255 bp, Homo sapiens
gctcagcaaggggtccgtccttctctgtcactgtctcttttgcctgttgtaattctgtctgcctctctgggactctgcctgtctcactctttctgtctgtgcctctcctcactcttgttctttctgcctgaatcacagccctcagtttttctgtcctcatgcatttgtctttgtggctctttccgtctttctgcccttgacaccatcccctctcccagtgcttcccctctgcttccagatcgcttcatgacttag

SEQ ID NO: 332 - DNA, 255 bp, Homo sapiens
ggaagtggcgggggcggtgccatggcaaaagaactcccggataatccgaattcgtggtcctcagaattggtttagggttgtttcgcggttcttcccgtattctgcctccgaggcccagtggggctggctgtgggccccctgtgctgtttgaggcgtgaaactcacctcaggaaatgtatctgatccattagcgtggattcatattatttggtgatggagaatcttcagctgtgttaagtgttaccgtcagtttca

SEQ ID NO: 333 - DNA, 255 bp, Homo sapiens
attggctgaggccgataccacgcgccccgatacccggcgcaggagccacctccctgagccccgcggaccacgcctcagtccgcctgcgctcctcagcctgacggtccgcctttcggggctcctcagccttgtcacccgctcttggttttccttttctcttcatctttggctcctttgaccactcgaagccgcgcagcgggttccagcggacctcacagcagccccagaagtggtgcgccaagcacagcctctgct

SEQ ID NO: 334 - DNA, 255 bp, Homo sapiens
tttctcgctcgctcccgttccccggacgcggcggatgagccggccccgctggggaaggctccgggcggcggcgggcggccgggaggaggctgcgtgctcggggctggggctgcgagcggggtgattttgtattaaaatgaggaggaggaagaagaggcacccacagcggcagcggcggcggcggcggcagcagcagcaggagcagcggcggagagggctgcagcccgggcggacgcgcggagccgagcggggcac

SEQ ID NO: 335 - DNA, 255 bp, Homo sapiens
gagacggcggcggcgcccgtaggatgcagggatcgctcccccggggccgctgagcctgcgcccagtgccccgagccccgcgccgagccgagtccgcgccaagcagcagccgcccaccccggggcccggccgggggaccagcagcttccccacaggcaacgtgaggagagcctgtgcccagaagcaggatgagaagatggcaaacttcctattacctcggggcaccagcagcttccgcaggttcacacgggagtcc

SEQ ID NO: 336 - DNA, 255 bp, Homo sapiens
agcagcagcgaatgcggggtaggggggaggtggggtggctcaagactcgcgcacgcgcaccacggcctacctgcgcctgggctgccggtgacctgggccgagccctcccggtcggctaagattgctgaggaggcggcgggtagctggcaggcgccgacttccgaaggccgccgtccgggcgaggtgtcctcatgacttctcttgtggaccatgtccgtgatcttttttgcctgcgtggtacgggtaagggatgga

SEQ ID NO: 337 - DNA, 255 bp, Homo sapiens
gcgtcatcaacctgcgcggcggccgctcctgcagccgcggccgccgccactgccgggagagctcgatgggcttctcctgcgcgccgcccggtgtctggccgagtccagagagccgcggcgcctcgttccgaggagccatcgccgaagcccgaggccgggtcccgggttggggactgcaggggaaggcagcggcggcggcggcgggagccccaccggggtctgggactggggaactgcctccggcttcacgatgcc

SEQ ID NO: 338 - DNA, 255 bp, Homo sapiens; identical to SEQ ID NO: 337

SEQ ID NO: 339 - DNA, 255 bp, Homo sapiens
cggcggcggaggcgcggggccacccccaagccgagccggggtgggacggcgcgcctggcgaccgcgcactgagactgccgtgccggacccccgagccggagccgagcgcgccgaggccggggccatggagaaagcgcggccgctgtgggccaactcgctacagttcgtgttcgcctgcatctcgtacgccgtgggcctgggcaacgtgtggcgattcccgtacctgtgccagatgtacggcggaggtagtttcct

SEQ ID NO: 340 - DNA, 255 bp, Homo sapiens
cagtctacgcttgcgcggcgcaacagggccgactgcagctggaagatggcggcgtccgtggtctgtcgggccgctaccgccggggcacaagtgctattgcgcgcccgccgctcgccggccctgctgcggacgccagccttgcggagtacggcaaccttcgctcaggcgctccagttcgtgccggagacgcaggttagcctgctggacaacggcctgcgtgtggcctccgagcagtcctctcagcccacttgcacg

SEQ ID NO: 341 - DNA, 255 bp, Homo sapiens
agctcgcctgcccgtcggtccccgcggcggcggcggctgcccagtgacagcggcggcggtgccaggtcggccgtggtagcgtagggttgcgcggcccggaaacgcagagccggccaaagagcggcgcgacgtgagccggggccgtgcgcgaagagacctcgcgggcgcggagcgaaaggccggcgtgagtgagcgcggagacagtggccgccggcggcccaacccgtctatcccttcggccgccgccggcatgag

SEQ ID NO: 342 - DNA, 255 bp, Homo sapiens
cgaaatcggctggtttatattggcgcggcccagacggcagaggtctctgcggcgcggtcctcggagacacgcggcggtgtcctgtgttggccatggccgactacctgattagtgggggcacgtcctacgtgccagacgacggactcacagcacagcagctcttcaactgcggagacggcctcacctacaatgactttctcattctccctgggtacatcgacttcactgcagaccaggtggacctgacttctgctc

SEQ ID NO: 343 - DNA, 1820 bp, Homo sapiens
agtgcacttccggcgcgcagcgggcggccatgttggagcagcggaggcggcgcagaggcgcgtcttgggtccccgcggcggcgccggtgccaagcgctggtttgcggatacccaggcagatctgcagtgcctaatgccatgagtgtggtggttcagcatgtggaggaaaaagctgtgcactcctggtcgcgcatctccacggcagggaagaaggccctggaagaggcactgcttgtctttaacccaatgagccaggatctcagtgccacagaggcccagcttgtggccttcctgcagggcctgcgagatgatggcttccaacctaccatcctgcgcagtggtgatgtctatggctatagttcatgcacagctaatcccccaagccagacgaaactgcaagctcgtgcccctaacccaactgccacatcacctccagccagtgctccccgaactgccatgcggttgcctgcaggtcgggccacactgcttcccatgccgctatctggcagactggccaaagcatccacaccagcccttgccaagcatgctaccaccaacctgctgctgagctctctgaagcaatcaagtgccagccatgcccggggtgcagcagtgggcttccccacccacctttatccaggtgtctaccctgccatgcggctctctgttgtccttgaggccctggttccacttaagactcccatgccctgcttgggtgccaagcacaaggcacagtcactgcagctctcacttgcagactctcctctgaaactgcggaaaagttcagggaagggtccggggaaccctcggcccaaagctcccagaaaaaccacaagcaagggccccaagtgtctgactcgcaaaggccctggggctggaccccgacgaggctctgggcaccagagcaaaaccaacagagccactgggtcccccagtgtccggcgaatgaaagggggctctgccctgggcaccaaaacagcccaggccaaggtagctcgaacactggccaaagctgctcgtgcccaagccaaggtggctcgaacacaggccaaggctgctaaggcccgggccaaggccaaggcagcacaggtcaaggctaaggccaaagctaaggcagcacaggtcaaggccaaggccaaagtcatggcagcatgggccaaggccaaggctaaagccaaggcagtacgggccaaggccaaggtggctcggacccagcccaggggcagaggcaggccaaagggatctgctaaggccagaactacaaggaagggccagaaaaaccgccctgagactgttgggcagaagaggaaaagggctgaggaggcaaaagatcttcctcccaagaagagaacacggcttgggccccgatctcctaaggcatggctagggcctggaacagcaaagctgctgaagttccgtgccataaaggtagataggcggtcctcggatgatgaggtgcggcagcgggctcagcggatcctccgcgtgaacctgtcacctgtaatacggctccagccattgctgccatattcagcagtctgattccttcacacggcaatgtttggggaaactaagcccagctgtctgtgtggctagtggcacagtgtgctatgtccgtggactccacaatcttgaggactcccggtgcctctctagggccctggtgaccaccagcctcctttcagaaaccagagtgggtggggtacggtggggtgggtgggcgggaggggtgttttcatggcgcgatgcactgtgacttgttattcaagttgtatgtctactgttccatctatcacgttttatacctttccaaaaaaaaa

SEQ ID NO: 344 - DNA, 255 bp, Homo sapiens
cttttcttttctccaggaagagagctgtgaccagcagcgtcccttattcgcttggccttggttcctgtttgcactggctacagcagggcactggcccctactgtcaccgccacctacacaaagaccctatctctgagcgctgcagcctactgttcagccccaggtttgaggatggatgccctggacgcttcgaagctactggatgaggagctgtattcaagacagctgtatgtgctgggctcacctgccatgcag

SEQ ID NO: 345 - DNA, 255 bp, Homo sapiens
gtgcgaatccggtgccggcaagcggctggcgatgctggaggttcgctagccgaagcggctgcatctggcgccgcgtctgccccgcgtgctcggagcggattctgcccgccgtccccggagccctcggcgccccgctgagcccgcgatcacttcctccctgtgaccaaccggcgctgcaggttagagcctggcaatgccgtttgggtgtgtgactctgggcgacaagaagaactataaccagccatcggaggtgac

SEQ ID NO: 346 - DNA, 255 bp, Homo sapiens
ttctgcctgtcgccccaaaatggcggacacaatgagccggcgacgcgccggttgtccgtgaggtggctgtgaggacgaacggtcggcgaggctccacagtccaggcagaagaccctcgaccaagcaggaagaagaggaggaggcggcccaactgttggccgacttcccgctagccgccggcgcggcgcccgccccgcctgggttggcccctcggcagcccgcccgctcgccgccgggccccgccccggccctgcg

SEQ ID NO: 347 - DNA, 255 bp, Homo sapiens
aatatagatccggcaagagcttagctgtgatcactcctagctgctcagcaaaccactgaggttcctgggaaaaaaaaaaaaatatctcaagggtgtgttaacttgggacactcgttaactgggggaccttcttgaggcttttttccttctttttaaaaatcatctttgattattcttcttttctagtaaaataatatttagaaaaaataatgtcagagcacagcagaaattcagatcaagaagaacttctcgatg

SEQ ID NO: 348 - DNA, 255 bp, Homo sapiens
atttattgtgtggcggttgcacgctgtactcgcggcggcccggccctcgcccgggagtgcgtgtgtgcgcgcgtgtgtgcgcgagtgagtgtgtgcgcggggtgcgcgcgcgggcgggagtgggcgcgcgcggggaaaggcccgaaaacaccttagtttgcaccgagagaccatttgcagcggaacccgaaagtttgtaagaggaagagagcgcgcggcgagcgagcgagcgggccgggggcagcggcagcggcg

SEQ ID NO: 349 - DNA, 255 bp, Homo sapiens
gggcgtgggagtgggcgcgggcgcaggcgaacggctgccggtcaggtgtccttgtccccttgagttgcgcgggtcgtgttcgagggcatggacgacaggtaccctgcgcttcagcgggcccagctgcgtctggatttcatccacgccaactccaccactcacagtttcctttttggagcactggctgaattgctggacaatgcaagagatgcaggggctgaaagacttgatgtcttttcagtggataatgaaaaa

SEQ ID NO: 350 - DNA, 255 bp, Homo sapiens; identical to SEQ ID NO: 312

SEQ ID NO: 351 - DNA, 255 bp, Homo sapiens
cgggcttgtgccgccgccgccgccgccgccgcccgggccaagtgacaaaggaaggaaggaagcgaggaggagccggccccgcagccgctgacagggctctgggctggggcaaagcgcggacacttcctgagcgggcaccgagcagagccgaggggcgggagggcggccgagctgttgccgcggacgggggagggggccccgagggacggaagcggttgccgggttcccatgtccccggcgaatggggaacagtcg

SEQ ID NO: 352 - DNA, 255 bp, Homo sapiens
gaaaacctgaatacggaactgaagcagcagctcagtttctcactccgaagtggcagcagccagagagggagtcggtgtggacgcgaggagccgggcgcttagaacagaggcttgcacaggtggagatgtggaagtctgtagtgggccatgatgtgtctgtttccgtggagacccagggtgatgattgggacacagatcctgactttgtgaatgacatctctgaaaaggagcaacgatggggagccaagaccatcg

SEQ ID NO: 353 - DNA, 255 bp, Homo sapiens
gcactgcgaacgccggctgagctgagtctcgctgctcggtgcgaggcggcggagagcgaggcctggtgagcaccgccgaggcgcgggccagctcttcgaggttgtgcgcgggagtggcacggcgggcgggcgagcgaggggctaacttcagcggtggcaccgggatcggttgccttgagcctgaaatcatgaccaccccaggaaaagagaactttcgcctgaaaagttacaagaacaaatctctgaatcccgatg

SEQ ID NO: 354 - DNA, 255 bp, Homo sapiens
agtccggcccgagccgctcgcgctaggagagcgggcttcgggcacttgacatggcggcagtggcggcgactgcagcagcgaaggggaatgggggcggcggtggcagggccggggccggggacgccagcggcacgcggaagaagaagggcccggggcccctggccacggcgtacctggtcatctacaatgtggtgatgacagccgggtggctggttatagcggttggtctggtccgagcatacctggctaagggta

SEQ ID NO: 355 - DNA, 255 bp, Homo sapiens
cagccgtatccagcggactgtcctccgccgcgcgcccggcacagcatggggaggcgctgctgccggcggcgcgtgctggcggccgcctgtctgggcgccgcgctcctgctcctatgcgccgcgccccgctccctgcgcccggcatttggaaacagagccctgggctccagctggcttggtggggagaagagaagccccctgcagaagctctatgacctggatcaggacccgcgctcgaccctggcgaaggtgcac

SEQ ID NO: 356 - DNA, 255 bp, Homo sapiens
aacggctgctcagtggcgggagggcgggctaccgcgcccgggccctacccgccctggcgcactgctcttcccggtcatggaggcgccagccgccggcttgtttctgctcctgttgcttgggacttgggccccggcgccgggcagcgcctcctccgaggcaccgccgctgatcaatgaggacgtgaagcgcacagtggacctaagcagccacctggctaaggtgacggccgaggtggtcctggcgcacctgggcgg

SEQ ID NO: 357 - DNA, 255 bp, Homo sapiens
acaagtagtacttcacatcttgatagaccttgctttgttttgttttcatctgcttacttgaactagcccaccattatgatttcaacttctcctggtattctgtcgatggtgtaagtttcttgtatgggttggaaccccgagagcgcaccaacagacaacacgaggcggtgtggagcaacatgctgtttcaatgaacgccttggtgcaggccggctgaggcctaaaatggcgtcagccccaagtgaggacggggca

SEQ ID NO: 358 - DNA, 255 bp, Homo sapiens
atcagaacagagcgaggctcctggcgcactagggactccaggaggcagctccgccagagacgcgggtcgtgcttcgggaaaccggggggcggggggaggggaagagcgcagaaaagaaaacccaccaaggcggggactggcctgagcggggaggggcggcgaggccggagcccctctctgttgggcggactccccatggccagaggctgagctccactcccgccggccgctccctaggggaaggggaaggagagg

SEQ ID NO: 359 - DNA, 255 bp, Homo sapiens
ccttgccaagtaacagctttgctgtccaacatcgtgtgctgcttcgcgagaaagtcacattcggaccctttggctagattgcttattcatagggcttcttgactaaagcccttggagcactgggtttttcttgaagtatatgatcttagacgaattttacaatgtgaagttctgcatagatgccagtcaaccagatgttggaagctggctcaagtacattagattcgctggctgttatgatcagcacaaccttgt

SEQ ID NO: 360 - DNA, 255 bp, Homo sapiens
ccctccctcccgctgagctccagctgtgccagaggcacccgagccctgagagtccgccgccaacgcgcaggtgctagcggccccttcgccctgcagcccctttgcttttactctgtccaaagttaacatgtcactgaaaaacgagccacgggtaaatacctctgcactgcagaaaattgctgctgacatgagtaatatcatagaaaatctggacacgcgggaactccactttgagggagaggaggtagactacga

SEQ ID NO: 361 - DNA, 255 bp, Homo sapiens
acgtccccgccgggcccgcgcgcctcgtgcctcgcgcctcgcgcctccagccacgtccccgccccggctccggcgcgccgcggagttggctgctgggaggtgcgggactgggtgtggccggcggctctggtctcggctgtgagctgcgctctccacgccggctccgcgctccaggggctgctgagcgcccagcggacaccggcagcgcgcggtcgacgcgggcctgagctccctccagctgttttcactcattag

SEQ ID NO: 362 - DNA, 255 bp, Homo sapiens
gccagcaagtgtggctgagctccggggtgtgtggacgccgctttgttgcctgagatgaagttggagcccttgtttttgacattggatcctatactgtgagagctggttatgctggtgaggactgccccaaggtggattttcctacagctattggtatggtggtagaaagagatgacggaagcacattaatggaaatagatggcgataaaggcaaacaaggcggtcccacctactacatagatactaatgctctgc

SEQ ID NO: 363 - DNA, 255 bp, Homo sapiens
aatccgctcagctcctgcaatggggcctgcctgacacttgggcgctccttcagtctcgatgttgatggcaggacaaaggggcgcctggaccatgggtgatgtggtcgagaagagtttggaagggcccctggcaccttctacagatgagccctcccagaaaacaggagacttggtcgagatcttaaatggggaaaaggtcaaatttgacgacgcgggactctccttaattcttcagaatggcctggaaaccctgcg

SEQ ID NO: 364 - DNA, 255 bp, Homo sapiens
tcttcctacccatctgctccccagagggctgcctgctgtgcacttgggtcctggagcccttctccacccggatagattcttcacccttggcccgcctttgccccaccctactctgcccagaagtgcaagagcctaagccgcctccatggccccaggaaggattcaggggagaggccccaaacagggagccacgccagccagacaccccggccagaatggagctgactgaattgctcctcgtggtcatgcttctcc

SEQ ID NO: 365 - DNA, 255 bp, Homo sapiens
agcctggttggcagctgcggcgcagagtccagccgctggtgcgcggagcggttcaccgtcttcggagcggttcggcccagcctttcgcccaggcgcccaggcccgctgcgcgcgtgcgtgagcgcgcctgcgccgccggggccgctgcaaggggaggagagaggccgcctcaggaggatcccttttcccccagaaattactcaatgctgaaacctctcaaagtggtattagagacgctgaaagcaccatggacgg

SEQ ID NO: 366 - DNA, 255 bp, Homo sapiens
accatcgtcttgggcccggggagggagagccaccttcaggcccctcgagcctcgaaccggaacctccaaatccgagacgctctgcttatgaggacctcgaaatatgccggccagtgaaaaaatcttgtggctttgagggcttttggttggccaggggcagtaaaaatctcggagagctgacaccaagtcctcccctgccacgtagcagtggtaaagtccgaagctcaaattccgagaattgagctctgttgattc

SEQ ID NO: 367 - DNA, 255 bp, Homo sapiens
atggaagagaacagtaagaaggaccatcgggctttgctcaaccagggagaggaggatgaactggaggtgtttggttaccgggaccacaatgtacggaaagccttctgccttgtcgcatccgtgctgacctgtgggggccttctgctggtgttctactggagaccccagtggagagtgtgggccaactgcatcccatgccccttgcaagaagcagacactgttttgctgaggacaacagacgaatttcaaagatat

SEQ ID NO: 368 - DNA, 255 bp, Homo sapiens
ggaaacttttccccggcgccttcgccgccgccgcccgcgcccgggagcgcgcccttctctgcccgcggtcggtgcgctcggccggaggcgccgcggcggaacggaacccagagaagggcacgcggggcggcggcgctcggggcttgcccgcggcgagggaggctgcgcccaggtccccggccccgcgccgcgcgcccagccgcgccatgggggaggcgcccagccccgcgcccgcgctctgggactgggactacc

SEQ ID NO: 369 - DNA, 255 bp, Homo sapiens
cgcgccggttcggtccccggggctctgcgggcgccgggcagagacctgcggccagggcgtgtcccgtgtgcccgagagcgccggcggcggggccggagggcgggccctgggccgagtgacaggccgcagccccccgagcaccgtcgaagccggcgcgcccgcccggtgcagccgctgtgcgagagcgaccccgcggtccaagcctcgcgtggccctgccgggccccttctttccccgagtagggcgcagcttccc

SEQ ID NO: 370 - DNA, 255 bp, Homo sapiens
gcgtttgaaactccggcgcgccggcggccatcaagggctagaagcgcgacggcggtagcagctaggcttggcccccggcgtggagcagacgcggacccctccttcctggcggcggcggcgcgggctcagagcccggcaacgggcgggcgggcagaatgagtctgcaggtcttaaacgacaaaaatgtcagcaatgaaaaaaatacagaaaattgcgacttcctgttttcgccaccagaagttaccggaagatcgt

SEQ ID NO: 371 - DNA, 255 bp, Homo sapiens
aaaggcgtgagcgcgcgtgcgtgcgtgtgcgggtgcgtgagcgtgagcgcgcggaggccggaagcgagcgctgcgcagtcgggtggtcgcgggccatggagggtagcttttcggatggcggagcgctgccggaggggctcgcggaagaggccgagccgcagggcgccgcctggagcggggacagtggcactgtttcccagagccacagcagcgcctcggggccgtgggaggacgagggcgcggaggacggcgcgc

SEQ ID NO: 372 - DNA, 255 bp, Homo sapiens
aaagtgctgggattacaggcatgagccgccgcgccccgccccacgctcagtcttgaaattgtctggaacgggaaacggcaaacagcgagatatccgagcgagagtcccgccctgcatcagtttgcggaaccgccttggtagaaggagagaaggggagtggaggaagcacgggactggagggaccaaagttccccgatggcggcccaggggtgcgcggcatcgcggctgctccagctgctgctgcagcttctgctt

SEQ ID NO: 373 - DNA, 255 bp, Homo sapiens
tacttaccccgccagccccgggaggctcgcagagcgagcggcgccggcgtcatgtgactgcccggagttggtgccaggagccagaggggagccaggagcggagccgcgcggagccggggcccgagccggagcgcagcgagagcgcccgccgcacgcgcgcccgtccccgtcccctgcggccgccaacgccgcccggactggagccctgacattgctgcgctcggggggctccaggcagcccgtatcggggccttt

SEQ ID NO: 374 - DNA, 255 bp, Homo sapiens
acggaaatgaaaggagcacttccgggttcggcaataacctggagccggcggcgtaggttggctctttagggcttcaccccgaagctccaccttcgctcccgtctttctggaaacaccgctttgatctcggcggtgcgggacaggtacctcccggctgctgcgggtgccctggatccagtcggctgcaccaggcgagcgagacccttccctggtggaggctcagagttccggcagggtgcatccggcctgtgtgtg

SEQ ID NO: 375 - DNA, 255 bp, Homo sapiens
tctgggggctcggctttgccgcgctcgctgcacttgggcgagagctggaacgtggaccagagctcggatcccatcgcagctaccgcgatgagaggcgctcgcggcgcctgggattttctctgcgttctgctcctactgcttcgcgtccagacaggctcttctcaaccatctgtgagtccaggggaaccgtctccaccatccatccatccaggaaaatcagacttaatagtccgcgtgggcgacgagattaggctg

SEQ ID NO: 376 - DNA, 255 bp, Homo sapiens
ctttttattttgagcctttttgatactgaacatgatatctgagtgaagaatttttgttttattattaagaaataaatgtatcttgcttcttgagatctccctggcttcagcaatttgtagttatttccactatagaccattaagaatatatttcaaaggcaagctaacaaagttcaagtaaaaattattttttatatattacagcttctaattggcattggtttcttctcaggttaaagctgtatttttcttaaa

SEQ ID NO: 377 - DNA, 255 bp, Homo sapiens
acacacaccgcccaagcccggacggtggccgcgaagctagggccaccatggcggaccgcaggcggcggctccggccggggacgttggccccggtgcgcgagggcgtgaactgcaggtccagatgtttcacaaagcacaagaacgggctgaagttccccacctctctgcacagccggcagttggtatttccaagaaaggggctggacgacttcaggaagggctgcccgccttgcactggtctggtgactcaggtcc

SEQ ID NO: 378 - DNA, 255 bp, Homo sapiens
cttttcctgcccacgtggtctcgggctcctgccccgtcctgctcacgagttcagggctcctgggcggccgccttttccagttccaggtgtgcagaagtgtcctctccccacgcgcggcgggctgcacttggtcgctggctccgagatcgcgcggggccgccggaagcccaagacggtaccgggggccgcagccgcagccggcgccgccctccgccctccccaacagcaggccgagtcccgtagcatccggtaggg

SEQ ID NO: 379 - DNA, 255 bp, Homo sapiens
gtgtcctgggtcgggggtggggcgagggagagccaggaggcggaagttcccgcgggcggtggggacggcgccctcaccgcgagtcacttgtcagcccttgtctgaggcggaggcagccccgcgccgcgccggacccgagcatatttcattttctgtcattggactttgagccattagaaccatgagcaactacagtgtgtcactggttggcccagctccttggggtttccggctgcagggcggtaaggatttcaa

SEQ ID NO: 380 - DNA, 255 bp, Homo sapiens
gattggctgggacggctgtgggtggggagaagccgggaggactgggtgcgcctgcagggatcggaagccggttggggtgtgagaggttttctcgctctagggagattcttcaagcaatcactatgtcaacagacacaggtgtttcccttccttcatatgaggaagatcagggatcaaaactcattcgaaaagctaaagaggcaccattcgtacccgttggaatagcgggttttgcagcaattgttgcatatggat

SEQ ID NO: 381 - DNA, 255 bp, Homo sapiens
aaaaagagaaactgttgggagaggaatcgtatctccatatttcttctttcagccccaatccaagggttgtagctggaactttccatcagttcttcctttctttttcctctctaagcctttgccttgctctgtcacagtgaagtcagccagagcagggctgttaaactctgtgaaatttgtcataagggtgtcaggtatttcttactggcttccaaagaaacatagataaagaaatctttcctgtggcttcccttg

SEQ ID NO: 382 - DNA, 255 bp, Homo sapiens
caggctcagaggctgaagcaggaggaaggaaggactggaaggaaaaagagacaggttagagggaaagaggcttgggaagaaaacagcagaaaagaaactgctcattacacttacagagaggcaagtaacggtggagatgaggacagagggaaccaagactctgaaagacaaaaaatacaaatagagcgaaagaggaaaaaaatgtcaagaagaacatccatccggagaaatgaagagaatgaaagttttaaactg

SEQ ID NO: 383 - DNA, 255 bp, Homo sapiens
gcttcctccagagggcgggaaccttggacgtggcggggctgggtcagtcagggcgctgggcccagcctctctgcaggctggccttccgcgctgccgtgaagcccccgacaggtcccacgcctgcctaggtagaccggcgccagcccgagtgacgcctggcgtgtggccgcgggcaggcggctccgtgcggcggggcgggcgggtgccacacctgtgcgggcaagggcggggcgggaaggtgcgcaggcgcgctcg

SEQ ID NO: 384 - DNA, 255 bp, Homo sapiens
gaaagtcttggtttggccttgggttccgctgtaggggaggtcccgtgcgaaagaatgaggagatcctggggccttacctactagcggaatcgactgaagagacgcctgccagtgcgggaggtaggaagctcgatccccaaagaaaagagcgagtgggcaggcagctgcgagacagaaccggagtgtgcagggtccctagaggccggttcctggtctgtgctgctctcctggaagccatggtacaggcagagctca

SEQ ID NO: 385 - DNA, 255 bp, Homo sapiens
gggaaacgagtggagacacgaggaccagcgcgagcggtcccggtgggctaccctccccctgcgacgaccccccctcgctctgaccgactggtcccctaaacggtggcggcggtttttggtcgttgggccccgggatttaggaccaacatttgaagacccgaaggggaactgcaaccatgaatgaagaaaatatagatggaacaaatggatgcagtaaagttcgaactggtattcagaatgaagcagcattacttg

SEQ ID NO: 386 - DNA, 255 bp, Homo sapiens
gagtcgcgcacgcgcgcccgggactgcctgcccctctctgtgacttgcctgtgtgtgtgcgtgtgtgtatgtgtgtgtgtgtgtgtgtgtgcgcgcgcgcgtgagtgagagaggagagagggagaagagagcgcgagagagggtgagtgtgtgtgagtgcatgggagggtgctgaatattccgagacactgggaccacagcggcagctccgctgaaaactgcattcagccagtcctccggacttctggagcgggg

SEQ ID NO: 387 - DNA, 255 bp, Homo sapiens
gcttcgacttccgggtgagaccgtgaaggtgtggcgcgacgttggagaccggggcagcgccatgtaccacagtggatggaaggatgcgcggtgcggcggggcagctgtcctcttctccccggacccagcgcctggagagccagccctgcagggtgggctgggcgagccaaactgcgttcctggtgcagggcttcgggtctccctaacagaccttatacgctgaccggcggccgccatggcagtgtctctttgctc

SEQ ID NO: 388 - DNA, 255 bp, Homo sapiens
gcgcccgccggtcccgtcgccgccgccccgcactcgggcgagcgcgggagccgcgcagtagacggagcgcgcccggccgagcgggccatggccgcgggggccgccgccgcaggtggtggcgcgcggtgaggagagcgcggcgccccctccggggcggatggaacgcggctcggcgggcgggcagtgccggcgtccgcggctggaatggtgctggctgtgttggtcggtgcctgcgttctgaagcccgagaggagc

SEQ ID NO: 389 - DNA, 255 bp, Homo sapiens
ctcacacttttgctctcttgcagtcagttgctttgctggcttctgcaggcttttaaggtctcgcggcgtagaaatgcctggcccccacccccttcctcggtctcccctttcaattcagatgtgctgatgtgcagaccggattcatcttctcggagctgcggcggcggctttgggctcaggcggcggcggctcgcgctcggccgcggagtcctggcagcagcggggacgcggcgcgggagtccgagctctggtggc

SEQ ID NO: 390 - DNA, 255 bp, Homo sapiens
aggcacacaggcaaaatcaagttctacatctgtccctgtgtatgtcacttgtttgaatacgaaataaaattaaaaaaataaattcagtgtattgagaaagcaagcaattctctcaaggtatatttctgacatactaagattttaacgactttcacaaatatgctgtactgagagagaatgttacataacattgagaactagtacaagtaaatattaaagtgaagtgaccatttcctacacaagctcattcagagg

SEQ ID NO: 391 - DNA, 255 bp, Homo sapiens
ggcgcggggacgcgggtttctgcctcaggccctgccctgctctactctgcgctctctgcccgcgccgccgccgcctcagcctcggccctgcgctgcgcgcccggcccgtgctgccatggcctgccgcccgcgaagcccgccgaggcatcagagccgctgcgacggtgacgccagcccgccgtcccccgcgcgatggagcctgggacggaagcgcagagccgacggcaggcgctggaggcccgaagacgccgagga

SEQ ID NO: 392 - DNA, 255 bp, Homo sapiens
ctcccgtgaggcagtgcgaggcgcgcggggcacggagggcggtggcggcgggctcctgcgagaagcaagcggaacttcctgaggaggaatcattatagattctaaaaatatattttcccttctctgtggacttggtataaaacgtagctttttttctgcttggatttattttctaaaaatcaacaccgtaaacccatatcagatacaacaaaattggggtagttaaaaccatgagttgtggaaatgagtttgtgg

SEQ ID NO: 393 - DNA, 255 bp, Homo sapiens
tagtaagacaggtgccttcagttcactctcagtaaggggctggttgcctgcatgagtgtgtgctctgtgtcactgtggattggagttgaaaaagcttgactggcgtcattcaggagctggatggcgtgggacatgtgcaaccaggactctgagtctgtatggagtgacatcgagtgtgctgctctggttggtgaagaccagcctctttgcccagatcttcctgaacttgatctttctgaactagatgtgaacgac

SEQ ID NO: 394 - DNA, 255 bp, Homo sapiens
agccaattctgaccgtgtcaacgaatcatccacgcacctgcagctctgctgagagagtgcaagccgtgggaattcagcagctgaatatcaagacctttgaattcaacaagaagttaagacatttatagttgtctaacaacagactgaagattgtggcttggtattcactggcaggtttcagacatttagatctttcttttaatgactaacaccatgcctatctgtggagaagctggcaacatgtcacacctggaa

SEQ ID NO: 395 - DNA, 255 bp, Homo sapiens
agaaacggcagtggcagcagcgtccggagcagccgcagccttctggaagctccaggcggtctttctgccgagcctcggtcccggcccccatcctccccgccccatcggttgttgtctgggcggatttaaacagtcaagtaaaatcaagctgggtaatcatggcagaaggtggatttgatccctgtgaatgtgtttgctctcatgaacatgcaatgagaagactgatcaatctgttacggcagtcccagtcctact

SEQ ID NO: 396 - DNA, 255 bp, Homo sapiens
gatttcagttgaaagatgtgtttttgtgagtagagcaccgcagaagaactgaagactgttgtgtgctccccgcagaaggggctaccatgatcctttcctcctataacaccatccagtcggttttctgttgctgctgttgctgttcagtgcagaagcgacaaatgagaacacagataagcctgagcacagatgaagagcttccagaaaaatacacccagcgtcgcaggccgtggctcagccaattgtcaaataaga

SEQ ID NO: 397 - DNA, 255 bp, Homo sapiens
gaggaaaggagaacacaaagtaaaagtgacactgcctatttcttcacgggtacaagggccacttaggctgggatgcttttcctgaaaatgcagaccatacagaacaaggccatgtgactaagaatccacaacagaaacaaacacaagacacatatgagttaggaaagttaaggaagcagtccttcctttcggccaaaactgccaccttccagtaatttgccacaatgatgaacacaaagggggaagaggagaggc

SEQ ID NO: 398 - DNA, 255 bp, Homo sapiens
actgagtcccgggaccccgggagagcggtcaatgtgtggtcgctgcgtttcctctgcctgcgccgggcatcacttgcgcgccgcagaaagtccgtctggcagcctggatatcctctcctaccggcacccgcagacgcccctgcagccgcggtcggcgcccgggctccctagccctgtgcgctcaactgtcctgcgctgcggggtgccgcgagttccacctccgcgcctccttctctagacaggcgctgggagaaa

SEQ ID NO: 399 - DNA, 255 bp, Homo sapiens
ctgccccgggtcacgtgcttaggagccatattgtcgctagtggccgctggggctgggaggggtgtgctagagaggcgcagcttctctgggcgtggtttttatcctgggggaaggatcggtggaatgtgaggggaggtggaggagatggcggcgacggcccgggaagatggcgccagcggtcaagagcgaggtcagcggggctgcgagcactatgacagaggatgtctcctaaaggcaccttgctgtgacaagctt

SEQ ID NO: 400 - DNA, 255 bp, Homo sapiens
gcgcgcgcgcgcgcgtgtttgtgtgtgtgtttcccctgccgcggggaaatggctgctgttgcttctgggccagaggaagagaatgagactaatagggatgccaaaggaaaaatatgatcctccagatcctcgcagaatttataccatcatgtcagcagaggaggtagccaatgggaaaaaatctcactgggcagaattagaaatctcgggtagagtgcggagcctaagtacatcactttggtcattgacacactt

SEQ ID NO: 401 - DNA, 255 bp, Homo sapiens
agcagaggagacccaggggtcccagagctgggctggcgggaggcgtaatccggcggggtgagggttgatcgaagagccccgcgcgcagctgccgctcacagccccttcccgagtgcagagcgggcagagaagtccactgcttttaaggccctgcactgaaaatgcaagctcaggcgccggtggtcgttgtgacccaacctggagtcggtcccggtccggccccccagaactccaactggcagacaggcatgtgtg

SEQ ID NO: 402 - DNA, 255 bp, Homo sapiens
ccagcgctgctccccgggcgctcctccccgggcgctcctccccaggcctcccgggcgcttggatcccggccatctccgcacccttcaagtgggtgtgggtgatttcctggcggggggagcagccaggtgagcccaagatgctgctgcgctcgaagcctgcgctgccgccgccgctgatgctgctgctcctggggccgctgggtcccctctcccctggcgccctgccccgacctgcgcaagcacaggacgtcgtgg

SEQ ID NO: 403 - DNA, 255 bp, Homo sapiens
aaagctgtcgcccctctctcggatgctcaggctgggcagcgctggacagatgggtacaccccgggcctgacggatgaacagtcgggcaagtgaactctcacctccaaactggctctgcgcccggcgggggcggcggcggcgtctgcagccccgcggtgggggcagccccctcggtctacgcccgactgctgcgcgccgcctctgctcttggcatagtaatttcagttcctgaacgcacggagctcgctccgggac

SEQ ID NO: 404 - DNA, 255 bp, Homo sapiens
gcaggaccgtcattgacgccatgagcgcgctgctgcggctgctgcgcacgggtgccccagccgctgcgtgcctgcggttggggaccagtgcagggaccgggtcgcgccgtgctatggccctgtaccacactgaggagcgcggccagccctgctcgcagaattaccgcctcttctttaagaatgtaactggtcactacatttccccctttcatgatattcctctgaaggtgaactctaaagaggaaaatggcattc

SEQ ID NO: 405 - DNA, 255 bp, Homo sapiens
ccgcgacttcggcttcgcgagtagcattggttccttgggtttatttcgttttcctctctcttctccaccttagtcgcccctttcgcgctgcgctgtagcgtgctctcacagcctttttgccttgaactgaatgcaggtgggaaacaggtcggcgtgccgaaagacaccgagtaggtagaaataaggcaaactcacagaggcgcaacaggtccggtcctccgtggccagggcgagccgcggccccgcgtggcgcct

SEQ ID NO: 406 - DNA, 255 bp, Homo sapiens
tatctgcctgggacgccgcgaggcagaagtaggcgggcccattgacttagtgtcaaggcggaggccgcgcttcatgccagcggtcacggaggcagcggaaagccgagccaggcgcctgcgcgctgggaagagtaggttcagagtgcattccggaacccggggcgcggcgcactgcgcaggcggccggactccgctcagtttccggtgcggcgaacaccaaagtccgggaacttaagcattttcggtttctagggt

SEQ ID NO: 407 - DNA, 255 bp, Homo sapiens
cgcatcgcatggccagaaggcggggagccagaggcgccaggaccctcgcgtggcgctccagcaccccagaccgtggcggcgcctcgccttagggaagagcaagggaagaactttatttgaaccgcgaacattttttggtcactgagatcgagtctcccagtgctttggcttcccgcctctttatcgtgggtttgatccctgagctgctctcctttcccgaacctcccggggtgcagcctagagccctcccgcgcg

SEQ ID NO: 408 - DNA, 255 bp, Homo sapiens
gcaggcgccgttggggtgcgcatccggggacctgcaggttacaagcagcagatcccaccttcagtcctggctctgacaagccctccagcttcacgccacccgggatgggagaaagcaggtgtcgcgagagttgggcgcaagacgccttgtagggagtgtaactatggccggcctgcggaacgaaagtgaacaggagccgctcttaggcgacacacctggaagcagagaatgggacattttagagactgaagagca

SEQ ID NO: 409 - DNA, 255 bp, Homo sapiens
acttccttcgtctgggtggttgccccagcgacacgttgggccgaagagcggtgttgggtacccgagagacccggcggtggggaagtcacttcctcccgaagacgctgtttcctagcaaccgccctccgcctctgttattagcccctcctcctcgctcggtccaggaccggctctgcgggcgccgccaggcccagaccaagctactatcagaagttgaattctaataattagctattttataaaggtaacgagaaa

SEQ ID NO: 410 - DNA, 255 bp, Homo sapiens
gcccggagagccgcatctattggcagctttgttattgatcagaaactgctcgccgccgacttggcttccagtctggctgcgggcaacccttgagttttcgcctctgtcctgtcccccgaactgacaggtgctcccagcaacttgctggggacttctcgccgctcccccgcgtccccaccccctcattcctccctcgccttcacccccacccccaccacttcgccacagctcaggatttgtttaaaccttgggaaa

SEQ ID NO: 411 - DNA, 255 bp, Homo sapiens
agtctcgcgggaagctccgttgtgggcgccccggctggtggctgagctcaggccttcaggcagaggggaggcgagggcggggcggtcacgtgagagcactgccgcggtgggttgtgggggtgctgcggcgccgtttgctttgccaaaccgacaaaagagagatgatggccaacgacgccaagcccgacgtgaagaccgtgcaggtgctgcgggacacagccaaccgcctgcggatccattccatcagggccacgt

SEQ ID NO: 412 - DNA, 255 bp, Homo sapiens
tggctcagccgcggcggtggcgggggcgcaaccagcgggccgaggcggcggcgccagcggcgccttaaatagcatccagagccggcgcggggcagggagtgggctgcagtgacagccggcggcggagcggccggtccacggaggagaattcagcttagagaactatcaacacaggacaatgcaagcccatgagctgttccggtattttcgaatgccagagctggttgacttccgacagtacgtgcgtactcttcc

SEQ ID NO: 413 - DNA, 255 bp, Homo sapiens
gccccatcacgtgaccgcagccccagcgcggcggggccggcgtctcctggctgccgtcacttccggttctctgtcagtcgcgagcgaacgaccaagagggtgttcgactgctagagccgagcgaagcgatgcctaaatcaaaggaacttgtttcttcaagctcttctggcagtgattctgacagtgaggttgacaaaaagttaaagaggaaaaagcaagttgctccagaaaaacctgtaaagaaacaaaagacag

SEQ ID NO: 414 - DNA, 255 bp, Homo sapiens
attctttttttaacttttacttattcattaggatgatttcataatatatttcctggtttagaggaaacaggaacaatggctaccgagagtactccctcagagatcatagaaagagaaagaaaaaagttgcttgaaatccttcaacatgatcctgattctatcttagacacgttaacttctcggaggctgatttctgaggaagagtatgagactctggagaatgttacagatctcctgaagaaaagtcggaagctg

SEQ ID NO: 415 - DNA, 255 bp, Homo sapiens
acaggcctgagaatcagagaaaccttctctggggctgcaaggacctgagctcagcttccgccccagccagggaagcggcaggggaaagcaccggctccaggccagcgtgggccgctctctcgctcggtgcccgccgccatgtgggccgtcctgaggttagccctgcggccgtgtgcccgcgcctctcccgccgggccgcgcgcctatcacggggactcggtggcctcgctgggcacccagccggacttgggctct

SEQ ID NO: 416 - DNA, 255 bp, Homo sapiens
gaatgttcccgccgcgggctccgccccccggccaatcggaccggcgctcggtgaagcccagattctctttgttccgcagccatttcaggccccggacaggaggcagtgccgcttcggccgaaggcccgagcgcccgaggcgtctgggatggtgtgggaccggcaaaccaagatggagtatgagtggaaacctgacgagcaagggcttcagcaaatcctgcagctgttgaaggagtcccagtccccagacaccacc

SEQ ID NO: 417 - DNA, 255 bp, Homo sapiens
gcggccgcgggcgcgggcgggcgcgcgggggagcccggccgagggatgggctgcgcccccagcatccatgtctcgcagagcggcgtgatctactgccgggactcggacgagtccagctcgccccgccagaccaccagcgtgtcgcagggcccggcggcacccctgcccggcctcttcgtccagaccgacgccgccgacgccatccccccgagccgcgcgtcgggaccccccagcgtagcccgcgtccgcagggcc

SEQ ID NO: 418 - DNA, 255 bp, Homo sapiens
cgctccccgctgcctattctcatccggggtcacgtcggtcttccgggtgtctttgacagggttttctacgccgctttttcggcgactttttgctcttccgctttttgccaccgcccccaaccttctatatccttgcagcccctaccttttcttgtgttgctcctcccctggcagccgtgaggggggttagatctcagccggagccggagctgggcctagctgtcccacgggccaccactacctcctttggttcgg

SEQ ID NO: 419 - DNA, 255 bp, Homo sapiens
cagcagccagctccccagcaccgcacggcggggacgcgagcgcgcccccgacggcagcccggacgccgagcacgggtcacctgcggcgccggcccgggcgccgaccgaggttcaacgcacggcccggggacccccaggcggggccaacgccgccgtcgcccccggcctcgcggggagcaggaagagccaacatgctggccccgcgcggagccgccgtcctcctgctgcacctggtcctgcagcggtggctagcgg

SEQ ID NO: 420 - DNA, 255 bp, Homo sapiens
cgtttggttccgcttcgctggcgcccgccgggctcttcccccgccgaggcctgtggtttgtggagtcgaatttccctgccaccagtgcccggttagcaggggcgccagcctgggcgcctgcgcggacggcgggcgtcgtcaccatggcagcatccgctggaggcccaggatcttggagtgaaaatatactggaatattttctgagaaatagccagattacagcagaagacggtgctgagatcacctggtatcatg

SEQ ID NO: 421 - DNA, 255 bp, Homo sapiens
gaggcaggggtgagaccggcggccacccgtgagccctccgcacccgcaccatgcagaagagcgtgcgctacaacgaggggcacgccctgtacctggcctttctggcgcgcaaggagggcaccaagcgcggcttcctgagtaagaagacggccgaggcgagccgctggcacgagaagtggttcgccctctaccagaatgtgctcttctacttcgagggcgagcagagctgccgcccggcgggcatgtacctcctgg

SEQ ID NO: 422 - DNA, 255 bp, Homo sapiens
aggccggccgggggcggggaggctggcgggtcggcgcgggcccagccgtgcgtgctcacgtgacgggtccgcgaggcccagctcgcgcagtcgttcgggtgagcgaagatggcggccgagagggaacctcctccgctgggggacgggaagcccaccgactttgaggatctggaggacggagaggacctgttcaccagcactgtctccaccctagagtcaagtccatcatctccagaaccagctagtcttcctgca

SEQ ID NO: 423 - DNA, 255 bp, Homo sapiens
ggagcgggggataaggttaccacgcccgcggtggccggggacactctgagtttcgcgtgtggcttttagggacgtttatatttgaatttccctgaaccgccgagtgtgggcggtggcgcagatccgtcccggaaacctccgggctccttcccgcctttctcaggcccggcccctccaaggggtccccgcggggcggcgggagggccctgggcccagagccgcgcgggtgggcagtcccaggcgtccttccttaca

SEQ ID NO: 424 - DNA, 255 bp, Homo sapiens
acccgcccccaccccctccagcatctcgggccagacagagaaaaccttgttcaagtttgcagcaagtactttcccggtgcgcaaaactgggcgactgggaacgcgttgagacgttcctctttcccgcttctccacctttacgcctgaaagaagactcccaaagattgctttcttctgggacgctgcttggacgctaaccgcgttgattggaacagattttgtgtcttggctggctttgggtgaagaccggggaga

SEQ ID NO: 425 - DNA, 255 bp, Homo sapiens
tcaggctccaacatcctccccctgtcaagatgtggcacctcaaactttgtgcagtcctcatgatcttcctgttgctgttgggccagatagatggctccccaataccagaagtgagttcggcaaagagaaggccacggagaatgaccccattttggagaggggtttccctcaggcctattggagcctcctgccgggatgattctgagtgtatcacaaggctatgcagaaaaagacgctgttccttaagtgtggccc

SEQ ID NO: 426 - DNA, 255 bp, Homo sapiens
atccccgcctcccctcctgcccaggtgactgactaatccgccgccttcaggagacagaattggccaaggcctgaaggccccggagtgcaccagcggcatgtacaaagagaccgtctactccgccttcaatctgctcatgcattacccacccccctcgggagcagggcagcacccccagccgcagcccccgctgcacaaggccaatcagcccccccacggtgtcccccaactctctctctacgaacatttcaacag

SEQ ID NO: 427 - DNA, 6821 bp, Homo sapiens
gcggggcccaggctgcggctccgctcccggccacggggggcgctgcgctgcgccggtggttggtggtggctgttggggggggtgggggggaacggcggccgcgggtggtgcggagggaggccttgcgggcggatcgggcgcttggcggcggaggtggtgggaggcggcgggcgggagcgcgggtcaggccggccccggcgatggcggacgcggcggcctccccggtgggcaagcggctgctgctgctgttcgcggacactgcggcctcagcctcggcctcggctcccgcggcggcagcggcgagcggagatccggggcctgcgctgcgcactcgagcctggcgggccggcacggtgcgggccatgagcggggcggtgccccaggacctagcgatctttgtagaatttgatggctgtaactggaagcaacactcctgggtaaaagttcatgctgaggaagttatcgtgcttctgctggaagggtctcttgtatgggcgccccgtgaggacccagtccttctccagggcattcgagtctccattgcacaatggccagccctgacttttactccccttgtagataaactgggtttgggttctgtggttccagtggaatatcttctggatcgagagcttcggttcctgtcagatgccaatgggttgcatctgtttcagatgggaacagatagccaaaaccagattcttttggaacatgctgcactgagagaaacagttaatgctttgatcagtgaccaaaagctacaagagatattcagccgaggtccctacagtgttcaaggtcacagggtcaaaatatatcagccagagggggaagaagggtggctctatggtgttgtgagccatcaggactccatcactcgtcttatggaggtgtctgtaactgagagtggtgagatcaagtcggtagatcccagactaatccatgtgatgctgatggataattcaacgcctcaaagcgaggggggtacgttaaaagcagtaaaatcttccaaaggaaagaagaagagagaaagcatagaggggaaagatggccggaggaggaaaagtgcttcggactctgggtgtgaccctgcatcaaagaaattaaaaggagacaggggtgaagtagacagtaatgggagcgatggaggtgaggcaagccgagggccctggaaaggagggaatgccagtggagagccagggctggatcagagagccaagcagccaccgtctacatttgtcccccagataaaccgcaacattcgctttgccacttacaccaaagaaaacggcaggactctggtggtgcaggatgagcctgtaggtggggacacacctgcatctttcactccatattctacagccacaggtcagacacctttggccccagaggtgggtggagccgaaaacaaagaggcaggaaaaacactggaacaagttggccagggcatagtggcttccgcagctgtggtcactaccgccagctccaccccaaacacagtgaggatctcagacactggccttgcagcagggactgtgccagaaaaacagaaaggcagccggtcgcaggcctcgggagagaattcaagaaattctattctggcctcttctggatttggagcacctctccctagttcatcgcaacctttgacttttggaagtggaaggagccagtccaatggtgttctagccacagagaacaaacctttgggcttctcttttggctgtagctctgcacaagaggcacagaaagacactgatctctccaaaaacttgttttttcaatgcatgtcccaaactttacctaccagtaactacttcactactgtttcagagagtttggctgatgattcttctagtcgggactcattcaaacaaagccttgagagcctgagctcaggcctgtgtaaaggcagatccgttcttggaacagacactaagccaggctctaaggctggcagctctgtggaccggaaagtgcctgcagagtccatgcccaccctcactccagccttcccacggagcctcctaaatgcccgtaccccagagaatcatgaaaatctatttttacagccccccaaattgtcccgagaagagccttctaatcctttcctggcatttgtggagaaagttgaacacagccctttcagtagttttgcatctcaggcatcaggtagctcctcttctgctaccactgtcacctccaaggtggcacccagctggcccgagtctcactcctctgcagattcggcatctttagcaaagaagaaacccctcttcattacaactgactcctccaagctagtatctggtgttctgggctcagctcttaccagtgggggcccaagcctctctgccatggggaatggccgctccagctcgcccaccagcagcctcactcagcccattgagatgccaactctctcctctagccccacagaggagaggccaactgtggggcctgggcagcaggacaatcccctcctcaaaacctttagtaacgtctttggcaggcactcaggcggctttctgtcctccccggcagatttttcacaggagaacaaagctccttttgaagctgtgaaaaggttctcactggatgaacgaagcttggcttgcagacaagactcggactccagcaccaacagtgacctgtcagatttgagtgactctgaggagcagctgcaggctaagacaggcctgaagggaattccagagcacctgatggggaagctgggccccaatggggagcgcagtgctgagctgttgctgggcaaaagcaaagggaagcaggcccccaagggccggcctcggactgcccccctgaaagttggccagtcagtgctgaaagatgtaagcaaagtgaagaagctgaagcaatctggagagcccttcctgcaggatgggtcatgcatcaatgtggcacctcatctgcacaagtgtcgtgaatgccgcctggagcggtaccggaagtttaaggaacaggagcaagatgattctactgtagcctgccgtttctttcacttccggaggttgatcttcactcgaaaaggggtactccgtgtggaggggtttttaagcccccagcaaagtgaccctgatgccatgaacctgtggattccctcttcctccctagcagaagggatagatctagagacctcaaaatacatcctggccaatgttggggaccagttctgccagctcgtaatgtctgagaaggaggccatgatgatggtggagccacaccagaaagtggcatggaagcgagctgtgcgtggtgtacgggagatgtgtgatgtgtgtgaaacaactctcttcaacatccactgggtttgtcgcaaatgtggatttggggtctgccttgactgttaccggctcaggaaaagccggccacgcagtgagacagaagagatgggtgatgaagaagttttctcctggttgaagtgtgcaaagggacagtcccacgaaccagagaatctcatgcccacacaaattattcctggcacagctctttacaatattggagacatggtacatgctgcccggggcaagtggggaattaaagcaaactgcccttgtatcagtcgacagaacaaatctgtattgagacctgccgtcaccaatgggatgtcacagcttcctagcataaaccctagtgcctcttctggaaacgaaactaccttctctggtggaggaggaccggcaccagtaacaactccagagccggaccatgttcccaaagccgacagcactgacatcagatctgaagagcctctgaaaacagacagttcggcatcaaatagcaatagtgaactgaaagccatcaggcctccttgccctgacacggccccaccctcctccgccctgcactggttggcagatttagcaactcagaaggctaaagaagaaacaaaagaagcagggtccctgaggtcggtgctcaataaagagtctcattcaccctttgggctggactcgttcaactccactgcaaaggtctctccgctgactccaaagctttttaacagtctgttgctgggtcccactgcctccaacaacaaaaccgaagggtctagccttcgagacctccttcactccgggccgggaaaacttcctcaaacccccttggacacaggcataccctttcccccggtcttctctacatcctcagcaggagtgaagagcaaggccagcctacccaactttcttgaccacatcattgcctcagtggtagaaaataagaaaacctcagatgcttcaaagcgggcctgcaacttgactgatacccagaaggaagtgaaggagatggtgatggggttaaatgtgctagatccccatacttctcactcctggctttgtgatgggaggcttctgtgtctccatgaccccagcaacaaaaacaattggaagatcttccgggagtgttggaagcaaggtcagccagtgctggtttcgggggtacataaaaagctcaagtctgagctctggaagccagaagcctttagccaggaatttggagaccaggatgtagacttggtgaactgcaggaactgtgctataatttccgatgtgaaagttcgggatttctgggatggtttcgagatcatatgcaaacgactacggtcagaagatgggcagccaatggtgctcaaactcaaggactggcctcctggggaagattttcgagacatgatgccaaccaggtttgaagatctgatggagaaccttcctctgccagaatataccaaacgagatggcaggctcaatctggcctctaggctacctagctactttgtaaggcctgatctgggccccaagatgtacaacgcctatgggttgataacagcagaagatagaagagttggtacaacaaatcttcacttagatgtgtctgatgctgttaatgtgatggtgtatgttgggattcccatcggggagggtgctcatgatgaagaggtactcaagacaattgacgagggagatgccgatgaggtgacgaagcagaggattcatgatggaaaagagaagccaggtgctttatggcacatctatgcagccaaggatgcagagaagatccgggagctgctccgaaaggttggagaagaacaaggccaagagaacccccctgatcatgacccaattcatgaccaaagttggtacctggaccagaccctccgtaagcgactctatgaggagtatggcgtgcaaggctgggctattgtgcagttcctaggtgatgctgttttcatacctgctggagccccacaccaggttcacaatctatacagttgcataaaagtagcagaagactttgtatctccagaacatgtaaagcactgtttccgcctgactcaggaattcaggcatctctctaacactcatacaaatcatgaggataaactgcaggtgaagaacatcatttaccatgcagtgaaagatgcggttggcaccctcaaggctcatgaatccaaactggcaaggtcctaggcatggagaaactccaagctcctctgtgaagcaggtctttcactcacaacacttaacagggaacggcagggctctttgctggagcagaggcccttcacccagagccagtgtggtcagtattccaaactctccagccactctcttctacgctgcctcaacactgaaggttgacacaggaaagtcgtactgttcacacacacagtttgagactccaagccaagagtgccacatccctatcctgtggccttttggaaatccaaattgcctgaacatggcggggctttcctgcacattctcctgatttgagattcacgggcacacctttcttttcttttcctcttgtgcctagttaagtggaaatgtgtttggagataggggaaatcacataactggtacaagtatggggtaattgcttaaacatgcctggtggaagtctgatagcgtctctgcacgtgacctctgacaaagcccatcccaggagacggggtgaagctattccccacactctcctgtgaacactggagtcttgcaagacccagggagaacccactgcttttcccaggaggctccaggattaggaaatgtgtgtatttagtgaaaaataggtttgtagtgaaatagttactatttcatgaaagtagatatttttagaatttttgaaataccacagttgttttcctggattataaggaaaggcacattacatttagtcttcctttcgatataaaactctttgaagaaatatgatttttagaaatcagctacccattatagcacaaaatcagccaaagcagaatttttaaaaattggcttttttaggattctttttctccccctcccatcttagtcttaccttgagggaacagtcatatgagaaggaactttgtcacatctaagctgtggtgtgttccccatgtgtgtgtacaacactggtgactccaggaaccattttcacctattaccagtgttccctggggactcctcttaatgtttccaaatgggaaggacagttgatttccaacatgaggttttttgttttttatccagaaatattttcagcaaaactttccaactgagtggagtctgattaaggatttatttgaaaatggtgggattcattggcccataggtacattggaaaatgtatatctctccagctgtactgtagtgccctgcaggctgtttatatgttcacagttacttttttttttttttttaaataaaagtcatttaatgtagaatacttttaatttcactttctgtattttaattttgttgaagggctgattgggatttccatgttcttattaaaaatctaacaaatctgaaaaaaaa

SEQ ID NO: 428 - DNA, 255 bp, Homo sapiens
actgctggcggctggagcggagcgcaccgcggcggtggtgcccagagcggagcgcagctccctgccccgcccctccccctcggcctcgcggcgacggcggcggtggcggcttggacgactcggagagccgagtgaagacatttccacctggacacctgaccatgtgcctgccctgagcagcgaggcccaccaggcatctctgttgtgggcagcagggccaggtcctggtctgtggaccctcggcagttggcaggc

SEQ ID NO: 429 - DNA, 255 bp, Homo sapiens
ggactgtactggttctgagattctgtgcaagcctcatggaaatgaagctgccaggccaggaagggtttgaagcctccagtgctcctagaaatattccttcaggggagctggacagcaaccctgaccctggcaccggccccagccctgatggcccctcagacacagagagcaaggaactgggagtacccaaagaccctctgctcttcattcagctgaatgagctgctgggctggccccaggcgctggagtggagag

SEQ ID NO: 430 - DNA, 255 bp, Homo sapiens
gggaggcagcaggttaggcagtgagaagttagtggcgctgctgggacgggggaaaggagacgcttcttcctcttgctgctcttctcgttcccgagatcagcggcggcggtgaccgcgagtgggtcggcaccgtctccggctccgggtgcgaacaatgctgactgatagcggaggcggcggcacctcctttgaggaggacctggactctgtggctccgcgatccgccccagctggggcctcggagccgcctccgcc

SEQ ID NO: 431 - DNA, 255 bp, Homo sapiens
gccagctcagagcttcctcgggtactcggccactcggggcatcgcggcggcctttctagccgctgtcccaagggttggtctcgcgctttcggctgcgagctctctgtggtgctggcagcgacatgtggcgcctcccgggactcctgggccgagctcttccccgtacactgggacctagcctctggagggtgactcctaagtccaccagcccagatgggcctcagactacctcctccactttgctggttcctgtgc

SEQ ID NO: 432 - DNA, 255 bp, Homo sapiens
ggaagcatagcgttcctgtccggaagtcctgagagggaaacgcccgcaaaggctggtttttaagcgggagcatctcttcactcgcagcaagtgcgcgtgcgctgcctctcagcccaaattggaaacatggccgtacggtcgctgtgggcgggccggctgcgggtgcagcgcctactggcctggagtgccgcgtgggagagcaagggatggccgcttccattcagcactgccacccagagaactgctggtgaggac

SEQ ID NO: 433 - DNA, 255 bp, Homo sapiens
aaacttccgagttaagccgccgctgaggccggaaggagctagacggcggtcgggtaggtgacggcttggttggggtcgctgcgaggggactactaggagcgccgaggcgtgagtcgtagcctgtggcttggggtcgggagtgcaggaggcgaaaatgtttgccattcttttgaaagtctggcctgggtgtgggagttcggtcatcgaacacttactgagagccagatacctgccaggcactgccctgggctccag

SEQ ID NO: 434 - DNA, 255 bp, Homo sapiens
ttattcgattattgtcactgctctccgaccatgcactgtcccttcagactctcctttcccaactgagtcagtcagaggagcctgggtgtctgcaggacataatctaagaccacaaaccaccttgttccacgtgagaaggaaacaagaaagaagggagccaggggaatcctgcaaatttttaggcaacctctttatctattggattactgacttgaggcaaacaaggaacagagatatgaagggtttgaaagattt

SEQ ID NO: 435 - DNA, 255 bp, Homo sapiens
aacagaagatgccggagaaggggggggaaaagtagatgcggatttcgtcctgacttctaaaaattcctcctctccctctcccattttcctaatccgagaatgatggagctcgaggcaaaggaatgattccggaaatggagatatgattctcaaacctagaaatgatcggagtgatttattagttaaatattcttcgtccaggaacccagcacaattcagagctgcagattggatattgggaagcaaatttgggtg

SEQ ID NO: 436 - DNA, 255 bp, Homo sapiens
aggaaggaagtggggccctgcggcgcccagccaccccctgacggcttccccacgggaggacgcgaggccccggcccagccatggccccctggcgcaaagctgacaaggagcggcacggcgtggccatatacaacttccaaggcagcggagccccccagctctccctgcagatcggcgatgtggtgcgaatacaggagacgtgtggagactggtataggggatacctcataaagcacaaaatgttacagggcattt

SEQ ID NO: 437 - DNA, 255 bp, Homo sapiens
gcgaagcctggctgaggctgcgaagggcgagcggcgcagggaccccgcgggcgtctggggcttccgcggcgcccgcctctgctccctcccctcgggcgctgggtgccgaccggccggctggccggcgccgcctcctgggaagatggcgctgcacttccagagtttggctgaattggaagtgttatgtactcatctctacatagggactgatcttacacaaagaatagaggctgagaaagcactcttggaacttat

SEQ ID NO: 438 - DNA, 255 bp, Homo sapiens
gggcggcgcccaatgggctgcgcggagcgtcacttcccggcagcgggaggcgagtggcgagtggcgagtggcgagtgtcaggggggcggccggcgggggcggggcggccggaggaggcgttggcagcgggctcggacccacgcggcgccgcggcccgcctggcctgcagcgctcccacccccggcggcggcacgatgccctttgacttcaggaggtttgacatctacaggaaggtgcccaaggaccttacgcagc

SEQ ID NO: 439 - DNA, 204 bp, Homo sapiens
tttccagcagtagtcagccatccggacagaaccgttcctgtgatggtgttacactgctgggagaggaatgtcttgtcttcatccggttgcctgcgccactgttctggtggcgtctggcactggtgcaagacagagctgtgcttccccgagagtgtgctaagcattcactttggctgcttagttctagtctgggagcagacagag

SEQ ID NO: 440 - DNA, 255 bp, Homo sapiens
aggcgcctgagaggctctctaccggtgagggtttgcggggaagatggagtatcccgcgccggccacggtgcaggccgcggacggcggagcggccgggccttacagcagctcggagttgctggagggccaggagccggacggggtgcgctttgaccgcgagagggcgcgccgcctgtgggaagccgtgtccggtgcccagccggtgggtagagaggaagtggagcacatgatccagaagaaccaatgtctcttcac

SEQ ID NO: 441 - DNA, 255 bp, Homo sapiens
ggccgggtagggggttcgcctgcggccgcgtctgctcggggcctgaggcctcgaagaccccagcccaagcccccaggttgatgccggcccaggatggatcagacctgtgaactacccagaagaaattgtctgctgcccttttccaatccagtgaatttagatgcccctgaagacaaggacagccctttcggatgatccagattccagtaccagtacattaggaaacatgctagaattacctggaacttcatcatc

SEQ ID NO: 442 - DNA, 255 bp, Homo sapiens
gcggctgagaggcgggcgggccgggggcgccgggcgcggggccgccatgtggagcggccgcagctccttcaccagcttggtggtgggcgtgttcgtggtctacgtggtgcacacctgctgggtcatgtacggcatcgtctacacccgcccgtgctccggcgacgccaactgcatccagccctacctggcgcggcggcccaagctgcagctgagcgtgtacaccacgacgaggtcccacctgggtgctgagaacaa

SEQ ID NO: 443 - DNA, 255 bp, Homo sapiens
agggggatacccaccatggtagaccagagccactggaaagaggcatgagtccacatatccataaaggcaaatatccaaatattggctgtctggacctacaggaatactaaagaaggcactgcagagacccacaactgagaaatactggctgtgtggaagccattacctactgttggaccgggtgtctcagattcttcaagagcatggtcataatgtgactatgcttcatcagagtggaaagtttttgatcccaga

SEQ ID NO: 444 - DNA, 255 bp, Homo sapiens
ccaaagcgtccgagactgggtacagtcgtccaggcgtgacgggggcgcggggagccagtgactcctctgggaggggaagggattagggccagaatctctcaaaggtgcaaaaatccagtcaagagagggttttcgggtataccacggaggattaaaactttcaagacaaatgcagtctttgcctaacagcaatggtgccgccgccggacgggactttaagatgaagttatgggatgtcgtggctgtctgcctggt

SEQ ID NO: 445 - DNA, 255 bp, Homo sapiens
gacttctgggatttgtggtcccggagaagagattggcggaggggaaagactgagtcgtctttcctttgcccgcttctgtggactgttcgaacgcccaggggtgggccaaacccgtttcttaggaaaccaggaatccagggaaggcagaatggcttcctttgggtggaagaggaaaattggtgagaaggtctcaaaggtcacttcccagcagtttgaagctgaagctgctgatgagaaggatgtagttgacaacga

SEQ ID NO: 446 - DNA, 255 bp, Homo sapiens
actttcgctatttgaagacattaggaagttatgtggtggctccgtaccctcctttctccatccgaggccggggtcctaaagtcggtgtcacggtggcagcacccagcgttttgttggctctttcgccagcagcgccgagcggggggttttctgtcacagcacttgttgcaccgaatttctcggtcgcagaacctctcttttccgagggtcgacattttctgcgtgacaacaccgttggttccgccaaaatggatg

SEQ ID NO: 447 - DNA, 255 bp, Homo sapiens
tgcgcctttgcggccgtgattcggtcccgctgtcctaggcgggatggtgccgctgtgccaggttgaagtattgtattttgcaaaaagtgctgaaataacaggagttcgttcagagaccatttctgtgcctcaagaaataaaagcgttgcagctgtggaaggagatagaaactcgacatcctggattggctgatgttagaaatcagataatatttgctgttcgtcaagaatatgtcgagcttggagatcagctcct

SEQ ID NO: 448 - DNA, 255 bp, Homo sapiens
aagagatgaaagatggttggtttaagctaatcttgataatcctattttcattcgcacatacttaagtttttagtctttcttaaaactagaggtggaaatgtgaaatttatcacatgagaaatttatcattgtcatttatagtggccatcagaaaagataatgaaataagacttttgattcttacttatataatccaatgtcagtaaatataagcactaatgaatgctgacttgaatgctcagggttttcttgaaa

SEQ ID NO: 449 - DNA, 255 bp, Homo sapiens
cagacagcccattttttcttatgataaagacggcatttggctcatgagcaaggtggcaagatcatcaagtgagtcagacgtgcagctctgggaaacagaagaggatgacatgacagaaggtgatttagggtatggcctcggaaggaaacctggtgggatttatgaaatagaattttcacataggtctagaaaaagatcagatggaaagaactttagccctcctccatttccgagaaagggagaagaaagaaatga

SEQ ID NO: 450 - DNA, 255 bp, Homo sapiens
ggcggggcgatctggagtaggaggtgtgaccggagggcgaaattggggcttcctctgctctggtgacccagaaccgtcaactgaaatgaccctgtctgtgtagtactccggcaggatgggcctcggagcgtaaaggcggcaaaaacaaaaatattaaaaaaaaggagagagggacaaaaaaaagaaaacccgaaagtttcagctgcattgctgcggaacgttttttagccagaaggcgaaagaagaaatcggaag

SEQ ID NO: 451 - DNA, 255 bp, Homo sapiens
ttaggctgtaattaggggatttgggaggagaactttcctggtgacgctttgcttttcttctgctcttggtgagaaagtgcctccttcttcccaggatcaggacctctgccatccagcgccacaaagagacattctgcacacacactcacacacgcacacacacacacactctcacactcgcccagagacaaacttaaggtgaggagaaagagcgctagcttcacttgatctccagcttccaacttaagcagaact

SEQ ID NO: 452 - DNA, 255 bp, Homo sapiens
gccctaggcttccgcgagatcttcggtgggggtacgggtgttttacgccaggacgctgatgcgtttgggttctcgtctgcagaccctctggacctggtcacgattccataatgtaccacaacagtagtcagaagcggcactggaccttctccagcgaggagcagctggcaagactgcgggctgacgccaaccgcaaattcagatgcaaagccgtggccaacgggaaggtgaggttttcccaacggttgcccagtt

SEQ ID NO: 453 - DNA, 255 bp, Homo sapiens
ggcagagccggaagaccctctctttcgctgtttgagagtctctcggctcaaggaccgggaggtaagaggtttgggactgccccggcaactccagggtgtctggtccacgacctatcctaggcgccatgggtgtgataggtatacagctggttgttaccatggtgatggccagtgtcatgcagaagattatacctcactattctcttgctcgatggctactctgtaatggcagtttgaggtggtatcaacatccta

SEQ ID NO: 454 - DNA, 255 bp, Homo sapiens
caacccgcgaggccccacactttctgcgccagctgggagtgcgcgccctgcagagccagtgggtgggcggttctagctcttcccaccctcactgcgggcctctgctgtcacacgcccggggtggcgaaacggtcgccacctgagtctccattctgctgcagtggcccctgcgttaaagctctctcgtggtgcggctgccgaggctgcggtagctcctgcgcccccgtgctggtggcgcagcctctgcttgctgcc

SEQ ID NO: 455 - DNA, 255 bp, Homo sapiens
atggagccccgggctgccgcggcgggcgagccagagccgccggcggcgtcctcctccttccaggcccggctctggaagaacctgcagctgggggtgggcaggagcaagggcggcgggggcgggcgcgctgggggtccagagcgccgcactgcggacaccccgtcgccctccccgccacccccggtgggcacagggaatgcaccggccagggggagtggtgcaggcagcaggtggagcggcttcaagaagcggaag

SEQ ID NO: 456 - DNA, 255 bp, Homo sapiens
cctcgtcccaggctgcaacggaggcagagccaacgcctcgcgggcttccacgtacgcactccaacgcgtgttcccggagaagaacgcatccgggtcacgggagccggtgtctcaggctccgccccttcaccccccgaaaggctaatccccacttccgaccctctcaggccttttccgcttctcttttacctccccaggtccgcccgtctgcgcccctcacaggaagccggagggtcgctctgatcccgaatctcc

SEQ ID NO: 457 - DNA, 255 bp, Homo sapiens
gcggctgcgcactgggcgctctcgcccgagaagccgcagtctcgagagcgtcaacgaggtgtttcggtagtctctggccatcctttctgcgcacccggtgtcgctgggctgcaccccgggcggggacgtccgccgggcacgggagggggccaagatgccgatcaataaatcagagaagccagaaagctgcgataatgtgaaggttgttgttaggtgccggcccctcaatgagagagagaaatcaatgtgctacaa

SEQ ID NO: 458 - DNA, 255 bp, Homo sapiens
cttattccggtttccagagcacgtctccaggcttcgacgtcaccacgctgggacgtatgtgccgagggccgcggcgtctgacctcatggcgtagagcctagcaacagcgcaggctcccagccgagtccgttatggccgctgccgtcccgaagaggatgagggggccagcacaagcgaaactgctgcccgggtcggccatccaagcccttgtggggttggcgcggccgctggtcttggcgctcctgcttgtgtccg

SEQ ID NO: 459 - DNA, 255 bp, Homo sapiens
agccgcgatgtgacgccgcgcgccccggggtcctcggcgcctgcgccctctcctataaagcagacgccgcgccgcgctgcgacgctgtagtggcttcgtcttcggtttttctcttccttcgctaacgcctcccggctctcgtcagcctcccgccggccgtctccttaacaccgaacaccatgccttcaattaagttgcagagttctgatggagagatatttgaagttgatgtggaaattgccaaacaatctgtga

SEQ ID NO: 460 - DNA, 255 bp, Homo sapiens
aatgtgtgcgcgctgtggtatgggtgtgcaagtgtgcgaaggcggcgtgttgtgtgagcgagagggtagcggatgtgtgtgtgcgtgtgcgcgcgtggctccgggtgtgcgccgctgcgatagcgggtcctttcccggggcgggcgacgggcgggctgggaaggtctcctcccctcaccacattgagaaatctcagtgagtcaccgagtggttctgcatattaatgagctcgctcgctgcgagggcaggagcgga

SEQ ID NO: 461 - DNA, 255 bp, Homo sapiens
ctcttgtgctctcctctagttttactgaactgccagtactttgaacacactttgtgctttttctcctccaggtctttgtgcatactgtttcctctgcctggaatactcttctttctctttacctgactcgtttctgctcttacttcaagtctcagattctaggaagctttccatcaacctgctatcactgggacgagttggccatcccctgtgcttctgtagctcctatgaaatcataatagttgaaatgtgatg

SEQ ID NO: 462 - DNA, 255 bp, Homo sapiens
cagagaaggcttaggctcccgagtcaacagggcattcaccgcctggggcgcctgagtcatcaggacactgccaggagacacagaaccctagatgccctgcagaatccttcctgttacggtccccctccctgaaacatccttcattgcaatatttccaggaaaggaagggggctggctcggaggaagagaggtggggaggtgatcagggttcacagaggagggaactgaatgacatcccaggattacataaactgt

SEQ ID NO: 463 - DNA, 255 bp, Homo sapiens
ctcccgcccaccggtgcccaacctgctaacacgcctgcgcgagcgggcgtgccccggaagccgttctttggccctgtgacacgtagcaacggggctggttcagggtctgaaacagagtttgggggttgtttgggattagtgaagctactgcctttgccgccagcgcagcctcagagtttggtgagtgacccaggcccgtggcacagtgttcagcttctctccacacccgtgcaaatgggcttgttgccgtctttc

SEQ ID NO: 464 - DNA, 255 bp, Homo sapiens
agttagcgcctgctgggtgtctgctcgggtggtctgggaactacaattcccggcgggctgtgagatgccttggctgtagttagtaaggagccggatgattgcctcagcaggtgtgaagcgtgtgctttagtttcgtgggaggcctggcatccccgagagggaggggaaaggtaaccactcctttgtggaggtcgccagggtcattgtcgtggatttgcacagtcggctgggcggtgcaatggcggaaagaaaagg

SEQ ID NO: 465 - DNA, 255 bp, Homo sapiens
actgcctttccaggatttattgcgaggatggagggaggcgcaggcgttctcattcatagttctcccatcctgaaagttctgttcctcttttgtccagaaactgggccctcgtcagactgccttgccctgttcctgactcaggccaaggcctgcagccgggaagaggttggggcggcgtgagttatgtgaaaagcgctcagaatacagtatgtcatgtaagaagctgaaagtgtatttatggagctagaggacaat

SEQ ID NO: 466 - DNA, 255 bp, Homo sapiens
cagtttcagggtctcgccggcagccccagccggcgggcgcggagcgggcagcggggcccggatcgcaggctcctctgggggccccggagttgggaagcggcgtccgggagcccccggaggaggatgggctgcagacacagcaggctgagcagctgcaaacccccgaaaaagaagcgccaagaaccagaaccagaacagccacccagaccagagccccatgaattaggtcccctcaatggggacacagctataact

SEQ ID NO: 467 - DNA, 255 bp, Homo sapiens
ctctagtgcgcactctcggaagcgcagccgaacccgccctccgaatccagagaggcgctgctgacaccgccgccacaccgccgccacaccgccgctgcctcagtcatgccgaagcacgagttctctgtggacatgacctgtggaggctgtgctgaagctgtctctcgggtcctcaataagcttggaggagttaagtatgacattgacctgcccaacaagaaggtctgcattgaatctgagcacagcatggacact

SEQ ID NO: 468 - DNA, 255 bp, Homo sapiens
ataagaggttgggctttggatagatagacagactcctgggtccggtcaaccgtcaaaatgtccaaagaacctctcattctctggctgatgattgagttttggtggctttacctgacaccagtcacttcagagactgttgtgacggaggttttgggtcaccgggtgactttgccctgtctgtactcatcctggtctcacaacagcaacagcatgtgctgggggaaagaccagtgcccctactccggttgcaaggag

SEQ ID NO: 469 - DNA, 255 bp, Homo sapiens
gagggctgggagccgggtggggaggcgcggggcgagccggggggttccagacgcgcctccaccgccgggcagtgggcaggtatggctgagggcgtgtgagcgccgagcgctaagggccgccgccaccatgccagggggcgcaggcgccgcccggctctgcttgctggcgtttgccctgcagcccctccggccgcgggcggcgcgggagcctggatggacaagaggaagtgaggaaggcagccccaagctgcagca

SEQ ID NO: 470 - DNA, 255 bp, Homo sapiens
gagagcgagcgccggccagctcacccggccgccccgtgccccagccgcagccgccgcgctccccagcccagccccaagccggacctccccgggcgccacgccccattgcgctcgccccaggtccccaacccggcccgcgggccagcggggccagggggcgctccgcacctgggcactcccagcgatgcgcagcggggcagcgccggccccgccgatggagctgctgttgctgccgccgccgccgcccggagcgcc

SEQ ID NO: 471 - DNA, 255 bp, Homo sapiens
gcggggcggggcccctgcgggcttgcagcgggctactgtttgccggagcctcccggcgcgcccccgcgagccccctcccgtctggcgcgcgaccccgccgcttcgaatgttgtgaatcaaatgtggggtttgttacattccgctgccgccgcggacagttcttaaagggccagccgccggctgccgcgcagacccagctgcgtcctgcgccgcctcccgctccctgagggcctgggccgagagagactgatcgcg

SEQ ID NO: 472 - DNA, 255 bp, Homo sapiens
aactcatgactcggggagccagactgcgatcagacgcgcgtgcccagctgaaccagctgtctctagacggagggacgggaagtggccagaaggggaagtgtgaggagttcccgtccagcctgtcatcagtctccccaggtcttgaagcggcggccctgctcctggccgtgaccatggaccctctggagacccctatcaaggatggcatcctctaccagcagcatgtcaagtttggcaagaagtgctggcggaagg

SEQ ID NO: 473 - DNA, 255 bp, Homo sapiens
cccagatccaggccgggccgcggctctcgccgcccagcccagcccagcccggcccggcccggccctgccgcggaggcgaggccgccagtgtcccgcgcccctgatatctgcagtgagcctgatacctgcctctgcccttctgagcctgttcctcttccctgagtacagggcacaaagcttgcgccctgaggggcggccggcgcgctccctggcccggtccccgcccggccccgggccccccgcccctccccgacc

SEQ ID NO: 474 - DNA, 255 bp, Homo sapiens
cctctcgaggcggggcggggcctccgcgttcgctacaaaagccgcgcggcggctgcgaccgggacggcccgttttccgccagctcgccgctcgctatggcgtcgctcaccgtgaaggcctaccttctgggcaaggaggacgcggcgcgcgagattcgccgcttcagcttctgctgcagccccgagcctgaggcggaagccgaggctgcggcgggtccgggaccctgcgagcggctgctgagccgggtggccgccc

SEQ ID NO: 475 - DNA, 255 bp, Homo sapiens
ggcggcggcggcggcggcgggcggcgccccggtccgcggcgccgaggctcgcaccgggagctgcccatgggccgggcccggagttccggcgcgccgggagccggcagacatgccacagacgctgagtgcctccgacatggtcaccccaggcagcctcagcccaccccccaccgagcccacagatggcgaacaggctgggcagcccctcctggatggagcgccatcctcagcctccctggaaacactgatccagca

SEQ ID NO: 476 - DNA, 255 bp, Homo sapiens
gatcacatggcagcagcccttcttggggaagtcagctacccagcagcctgtagtcctcggctacccaccctcaccgcctggggtcccatggtgagacagctgggtgggcatcaggcttctgcagagggccaggccggagggagctgggcgagggagtggggctggctcctggcttgcaccggcctcgtggaatccaggcctcagacctgatcgctggcgaaactggctctgtgcgctggagcccctggtcttctg

SEQ ID NO: 477 - DNA, 255 bp, Homo sapiens
acctcgcactctcagtttcaccgctcgatcttgggacccaccgctgccctcagctccgagtccagggcgagtgcagagcagagcgggcggaggaccccgggcgcgggcgcggacggcacgcggggcatgaacctggagggcggcggccgaggcggagagttcggcatgagcgcggtgagctgcggcaacgggaagctccgccagtggctgatcgaccagatcgacagcggcaagtaccccgggctggtgtgggag

SEQ ID NO: 478 - DNA, 255 bp, Homo sapiens
gcggccgccgccatcagcagcgcagctccagggccggctgcagcggcagcggctccgccgggcgtcctggcagcagcacatggattaattgatgtatgttgagtttatggagctgccttttggtggcttgctttatctgcagtttttaagaagaaaaagaaggccctgagtcaaagaagatgcctcgaactaaacaaattcatcccagaaatctaagagacaaaattgaagaagcacaaaaagaacttaatgggg

SEQ ID NO: 479 - DNA, 255 bp, Homo sapiens
gccatttttcagctgccggccgcagcacccgggctgccgccgccgcctcgcaatccgttgcatcggccgcccccgacgcctccatccccgcttggggcccgatatccgtgcggccgggaccctcctctctccagagccccgattatttttggcccccggggcctgtgcggtgcggaaaaataaaaagaaaagagagagagggggctcggaagcgccgggcggggaggagagaaggaggagagacttggaaactcc

SEQ ID NO: 480 - DNA, 255 bp, Homo sapiens
atgtcaggacgcggcaaaggaggtaagggcctggggaaagggggtgccaagcgccaccgcaaggtgctgcgcgacaacatccagggtatcaccaagccagccattcggcgccttgctcgccgcggcggcgtgaagcgcatttctggcctcatctatgaggagacccgcggagtgttgaaggtgttcctggagaacgtgatccgggacgccgtgacctacacggagcacgccaagcgcaagacggtcaccgccatg

SEQ ID NO: 481 - DNA, 255 bp, Homo sapiens
atgcctgaaccagtcaaatctgctccagtccctaaaaaaggctccaagaaggccattaacaaggctcagaagaaggatggaaagaagcgcaaacgcagccgcaaggagagctactctgtgtatgtgtacaaggtgctgaagcaggtccaccccgacaccggcatctcttccaaggctatgggaatcatgaactccttcgtcaacgacatctttgagcgtatcgccggagaagcgtcacgcctggcgcattacaac

SEQ ID NO: 482 - DNA, 255 bp, Homo sapiens
gtcatcccctcagtctgtagcccttttgtgtgagtgcctggcaagggtgacgtggggctgtttctgcgggcacagctgcagcaattaccggagtggaggcagggcccaggcagcactgccctccaagatcttcccttgggcttttcagcagtaaggggacatgcaccccaagggcctccacttggcctgaccttgctgcgggggctctctgtccccaggaacagtagagatggcaagcttatcaagaccctctct

SEQ ID NO: 483 - DNA, 255 bp, Homo sapiens
gtcttttataccatttagagttcaaaggatggtctttacagtctgacagagctagatctgaaatctaattctaccacttcctaggtgtgtgactcagggcaagtaacttctgtcagctttctcatctataaaatggagatgtaagacaaaaatctgcctctcagggttataaagaacaaatatgaattagatgtaaagagcttggtaagttctcaataaattctatctatctgtccttcacaggtcaagctcctg

SEQ ID NO: 484 - DNA, 255 bp, Homo sapiens
actttgatgctgtgggcacgcctcagagccagaagtttatggctcccacctgctcaatctgacaggaagcttctgctccccagttctccccagccactgtggtctacagattccaggaaacccatccccctgtgacctcatggtgtgctctgttctccaccctagggaccagaaggagccaggagtaaagaactggcttacttggccgccactgggaaattctgggtaattcgagacgccctggaatttggaccc

SEQ ID NO: 485 - DNA, 255 bp, Homo sapiens
atttctctactcacctgtctccgaatccgtcgtggtgtttcaagcgagtcaagattccagatcgcgccccaggctggactcggaattactgccccgcgggtctgcattttcacagcggcaggtggcttgtggtccctgacaaggaggaccctgagggcaaccacaccttgccatgcagagcacctggcttctcatctgccaagctcactctgacccggctgcaggaagggaaggagccaaccccggactcaagac

SEQ ID NO: 486 - DNA, 255 bp, Homo sapiens
agggggtgctcccgggggcggcggttgcccggatgggccgttagtcggggctcagccgcggagtgagcgagggagacgggaggagccgaacccggcgccatccgccgccatcctcccccgccccaccgccatcccgtcccggggagcccctaggcccgggtcccggatccccgcgcacccggccaggggacagagactgagacacttgctgtctggcccacaggctctggcacgttttgggggaggtgcctgcag

SEQ ID NO: 487 - DNA, 255 bp, Homo sapiens
ctggggctcttgagctataagtggcacctcagggccctgacgggcgtcttgccatgctgctcctgggcctgctgctgctgctgcccctgctggctggcgcccgcctgctgtggaactggtggaagctccggagcctccacctcctgcctcttgccccgggcttcttgcacctgctgcagcccgacctccccatctatctgcttggcctgactcagaaattcgggcccatctacaggctccaccttgggctgcaag

SEQ ID NO: 488 - DNA, 255 bp, Homo sapiens
ggcgggcgcgccaagacgtgggcacctcctcacccggaccccgggccccgccgagccgcctcctggctcccgtggccgccagcccgccccggccgcaccgagcgtcgggatccgaggtgggagcgtacccctccccgctccccggacgcctcagtcctccgcactgagcttggccacgcgcccctaggcgccccccacgccctgggccccggagggccgcagccatgagtgaaatgtccagctttcttcacatcg

SEQ ID NO: 489 - DNA, 255 bp, Homo sapiens
ttctctcacgaagccccgcccgcggagaggttccatattgggtaaaatctcggctctcggagagtcccgggagctgttctcgcgagagtactgcgggaggctcccgtttgctggctcttggaaccgcgaccactggagccttagcgggcgcagcagctggaacgggagtactgcgacgcagcccggagtcggccttgtaggggcgaaggtgcagggagatcgcggcgggcgcagtcttgagcgccggagcgcgtc

SEQ ID NO: 490 - DNA, 255 bp, Homo sapiens
ggcggcgcggggcgggcgcagcgggggtcggggcgctgggagcccgttgggccgcgaacgcagccgccacgctggggccgccgagatcgggtgcccgggatgagcctcatccggaaaaagggcttctacaagcaggacgtcaacaagacagcctgggagctgcccaagacctacgtgtccccgacgcacgtcggcagcggggcctatggctccgtgtgctcggccatcgacaagcggtcaggggagaaggtggcc

SEQ ID NO: 491 - DNA, 255 bp, Homo sapiens
agacacaaaatcagccagggggagcccacattggagggcagtccacaatggaaggcttcttggaggaggagatgattgagctgcttctactaagatgagtatctcagagtcctcaacgtgggtgtggccgaggtgaagaaatccttcctggggcccttgtccccgtcctgtaagatggtgcagatgatgaggcagtttctgtaccgggtcctgcccgaggactcctacaaggtcaccacggggaagctccatgtg

SEQ ID NO: 492 - DNA, 255 bp, Homo sapiens
atgtgattccagtatggcgtataaataaaggcgaggagaaggcggtggtccgccatttcgtggacgccgggtgagtgagagagttggttggtgttgggccggaggaaagcgggaagactcatcggagcgtgtggatttgagccgccgcattttttaaccctagatctcgaaatgcatcgtgattcctgtccattggactgtaaggtttatgtaggcaatcttggaaacaatggcaacaagacggaattggaacgg

SEQ ID NO: 493 - DNA, 255 bp, Homo sapiens
agctgaggtgtgagcagctgccgaagtcagttccttgtggagccggagctgggcgcggattcgccgaggcaccgaggcactcagaggaggtgagagagcggcggcagacaacaggggaccccgggccggcggcccagagccgagccaagcgtgcccgcgtgtgtccctgcgtgtccgcgaggatgcgtgttcgcgggtgtgtgctgcgttcacaggtgtttctgcggcaggcgccatgtcagaaccggctgggga

SEQ ID NO: 494 - DNA, 255 bp, Homo sapiens
gccgtccctgcggaccggacagtgcggccggcggccggcggccgggacggagcccccagcccgcgaggagggcgcggcgcaggcggcggcggcgcggcggggaggagcccgggccggaaccagggctgggccgggggcggggacgccggggtccgggagcccgggagccggagcgagctgacgagcgtcgcggaaggaccgggaaggaagagcggagccggagcgagccaagcagcccacaaagtgccatgcccc

SEQ ID NO: 495 - DNA, 255 bp, Homo sapiens
gaggcggggccaggacggcgggaccggccgctgggtcccagcgagggctgagccgggcggtgggaggaggtcaggatggtgggggaacggcatgctggggacctcatggtgcccttagggcctcggctgcaggcatatcctgaagaactcattcgacagaggcctgggcatgacgggcatcctgaatacctgatccgatggagtgtcctgaagtgtggggaagtgggcaaagtgggtgtggaagaaggcaaagca

SEQ ID NO: 496 - DNA, 255 bp, Homo sapiens
ggactccaactgggagggggcgccagcgcacccaggacgcggtgccccaagggaccccattccaagctgcaaactcaagtcccccgcctccccaggccaaacacacccccgcgcccgttcgcagctgccaccccgggtgttccaaagactccggcaaagatctgcgcctcccgggtctccctacccgccagcccgactgcgccgcatcgccagactctgttggcccatcagactccgcccggcagtcggcctcat

SEQ ID NO: 497 - DNA, 255 bp, Homo sapiens
atcctgcgcggcgcggggaaggaagcccgggagtgagagaaagcggctccgggggcatagcgggccagtaagggccgctcctcctttgaagaggttttgcgtctctttccgccggtggcgtcggcgctcacgcaggggcgggtcccggtagcgccaggcggtgcagggcgggaaggggattcgtggcgacggcggcggcagggacagcaggagcagtggtgctgtcagcgcggccgtcggagacatgggagaccc

SEQ ID NO: 498 - DNA, 255 bp, Homo sapiens
gcgcgctctcccgggctcacacacagccgcgcacgcacgcccggggccgctctccgcgccggcccttgctccccgcgcccatgcggacggaccgagcgacggaagatggctgacgactccacggggccccgaggatgcggcccggcggcggcggcggcgggagcggcagcggcagcgagggcggcaggggcagcggcagcagcggcggcgttggctgcggcggcggcggcggcggcagcaggagccggagcgacg

SEQ ID NO: 499 - DNA, 255 bp, Homo sapiens
gaactgggccaagcgcccccggaggcgctaagcttgcgccctgaggcggtttccgttcccggacgtttggactctgtcctggagaaggggaaggaaaaagtaagacgtagaagtacactgagacttcgtcacacataaaacaagcacgacaaagaaagagggcgcgaagggactcctggaagaaattgagtctacatttaagatcaccctaaaagtagtgacggcctcttcattactccaaaccccagatttaag

SEQ ID NO: 500 - DNA, 255 bp, Homo sapiens
gatagcggttggcgagaggccacatttccgccacgtgacccgcgcatgcgcctgcttgctggagagcgagcgtcttttgccacgaacacctgcggcgtgccgaagttcctcttctctgccccggttccgggcggtccgctgggaggtggcgcccggagggacacccgtgcctggggtcggggccagtgctcttctcggagctccagaagttctgctgagaagcgcggcggcagcaagacgacttctccggagccg

SEQ ID NO: 501 - DNA, 255 bp, Homo sapiens
agttaagcaagccgggtctggctttgggccctgggccttccagccggggactctgcgcctgcgcccgcctggccgccgcccgctctcccggcgcggcagctgtctgggctgctgcgcgccgcctaggtgtctgggcgatctatgggcaagagcaagggccacgatgacagattacggcgaggagcagcgcaacgagctggaggccctggagtccatctaccctgactccttcacagtattatcagaaaatccacc

SEQ ID NO: 502 - DNA, 255 bp, Homo sapiens
ggccgccatcttggattgcgaactgggtcgctacgcttcacgccaggggcggagtggcggcccttctgttacccgccacacacgtcgccgctggggactgggaaatcagggcatcggagagtgccacattaatggatgccatggctagtccagggaaagataactatagaatgaaaagttataagaataaagccctaaatcctcaagagatgcgtagacgaagagaagaagaaggaatacagcttagaaaacaaa

SEQ ID NO: 503 - DNA, 255 bp, Homo sapiens
gctgcccgaaggacctgttgtgccgggtccggaaagcgtgtttcgctccctttcccttgagggagtggggagggaatgtgactcttttcgcccagcgccgtggactcgcggcttgtggctcccaagttagggagtgagaggatcgcccgccgagggggtggctccgcagcccggctgcgcgagacgcttcccgctcggggacccgccttccgaggccaggtgaacgttaccggccccctgacctccagcagatcc

SEQ ID NO: 504 - DNA, 255 bp, Homo sapiens
ggaaaaaaaagatgcgccctctgtcactgagggttgactgactggagagctcaagtgcagcaaagagaagtgtcagagcatgagcgccaagtccagaaccatagggattattggagctcctttctcaaagggacagccacgaggaggggtggaagaaggccctacagtattgagaaaggctggtctgcttgagaaacttaaagaacaagagtgtgatgtgaaggattatggggacctgccctttgctgacatccc

SEQ ID NO: 505 - DNA, 255 bp, Homo sapiens
gggccgcgagcactggcgggttctgggtcctgtgaccggtcaggcggcgtcagcgggcgcggcggagggctggccggcctcgggggagtttccgcggccgccgggggcgcggcggcagagcgcgaggccgggcagggggccagactcggagtcgaggcgcgcccgacagccgcagcgctcatggcgggcggaggagccggggaccccggcctgggggcggccgccgccccagcgcccgagacccgcgagcacctc

SEQ ID NO: 506 - DNA, 255 bp, Homo sapiens
atggcccataacgcgggcgccgcggccgccgccggcacccacagcgccaagagcggcggctccgaggcggctctcaaggagggtggaagcgccgccgcgctgtcctcctcctcctcctcctccgcggcggcagcggcggcatcctcttcctcctcgtcgggcccgggctcggccatggagacggggctgctccccaaccacaaactgaaaaccgttggcgaagcccccgccgcgccgccccaccagcagcaccac

SEQ ID NO: 507 - DNA, 255 bp, Homo sapiens
gggtcactccgaggcgcgggctgcgggcggcgggcggcgggcgcaccatgccctccttcgacgaggcgctgcagcgggtgggcgagttcgggcgcttccagaggcgcgtgtttttgctgctgtgcctgacgggcgtcaccttcgccttcctcttcgtcggcgtggtcttcctgggcacgcagcccgaccactactggtgccgcgggccaagtgccgcggcgctggccgagcgctgcggctggagcccggaggagg

SEQ ID NO: 508 - DNA, 255 bp, Homo sapiens
agaaagaagccgcgcccctgaggagggcgctgcccggaagccacgctcacttctgcttgcacttaggcgacctcgggagctcggactcctacgcagtcaccgggaagggccgccgccccgcccgcggctgctggcccgggtgacgcttccgcctgctataagagcagcggccctcggtgcctccttcctgacctcgcacccagctcggagcccggagcgtgcctcggcggcctgtcggttttcaccatggagcag

SEQ ID NO: 509 - DNA, 255 bp, Homo sapiens
gcggcccgcgaatacgcgtggaccttgtggaacgccgggcctccccgggcgcccccgctctctggtagttgccgggagacccggccggtggggaagcccgcggagccgcagccccggccccggaaggtctctctgggccccgggcccgactcccacccctgcgccggcccgcgggcttcgcaggccctgcactgccgaccgggctgcgctcaaggccgccagccgcccgccgccctctttgtccccccgctgcag

SEQ ID NO: 510 - DNA, 255 bp, Homo sapiens
gagtgctggctttctcttaaagggtgagtgcgtgcgcccaggtggtttggcctgtgtgcgctagttacttgcacgcgcttcttgagtctcaaaacacagagctctagtaaacttcagggggcggattcgtcaattacagttgcggaagaagactcgactcgaagagcggtccgccaccagggctctttcggcagcgcccccagcgggcggggctcttgggcggggaagcaggagagggccgaccgagcgcaacaa

SEQ ID NO: 511 - DNA, 255 bp, Homo sapiens
gaggagagagcagagtataccgcagacatcatttctactacagtggcggagccgtacaggacctgtttcactgcagggggatccaaaacaagccccgtggagcagcagccagagcaacagcagccgcaagacattgtttctctccctctgcccccccttccccacgcaaccccagatccatttacactttacagttttacctcacaaaaactactacaagcaccaagctccctgatggaaaggagcatcgtgcat

SEQ ID NO: 512 - DNA, 255 bp, Homo sapiens
atgagcggcagcagcgccaggtccagccacctgtctcagcccgtcgtgaagagcgtgcttgtgtaccgcaacggggaccccttctacgcggggcgccgcgtcgtcatccatgagaagaaggtgtccagcttcgaagtcttcctgaaggaggtgaccggcggcgttcaggcaccctttggggccgtcaggaacatctacaccccgcggactggccaccgaatccggaagctagaccagatccagagcgggggcaat

SEQ ID NO: 513 - DNA, 255 bp, Homo sapiens
ttagccatggcacgaacaaagcaaacagctcgcaagtccaccggcggcaaagcgccgcgcaagcagctggccaccaaggcggctcgcaagagcgctccggccaccggtggcgtcaagaagccccaccgctaccgccccggcaccgtggccctgcgcgagatccgccgctaccagaagtcgaccgagctgctaatccggaagctaccttttcagcgcttggtacgggagatcgcacaggactttaagaccgatctg

SEQ ID NO: 514 - DNA, 255 bp, Homo sapiens
catgtctgggcgcggcaaaggcgggaagggtctgggcaaaggaggcgctaagcgccaccgcaaagttctgcgcgacaacattcagggcatcaccaagcccgccatccgacgcctggcacggcgtggaggcgttaagcgcatctcaggccttatatacgaggagacacgcggagttcttaaagtgtttttggagaatgtaatccgcgatgcagttacctacacggagcacgccaaacgcaagacagtcacagccat

SEQ ID NO: 515 - DNA, 255 bp, Homo sapiens
cccttgcaccctccttcttccctccgcccgggagctctccctggtccccggcgccgcctccttccctcccggctccccgctccccgctcccgtggctgccgccgccccggggaagaagagacaggggtggggtttgggggaagcgagagaggaggggagagaccctggccaggctggagcctggattcgaggggaggagggacgggaggaggagaaaggtggaggagaagggaggggggagcggggaggagcggc

SEQ ID NO: 516 - DNA, 255 bp, Homo sapiens
attccaggaagcgtttgcacatcctggccccagaagattttgcgtagcctcaccaagagaagaagttggaaagaaaaaaaaagaagttggcaaggcatccagaggagacccccccagcacctgggttctctgccaggggagagagttatgaagaagacttgagcaggcagtccagagctgatacagctgctccaatcaccagagatgcaatctcctgctagatgtcttcacatctacctttctatgtcacatgtg

SEQ ID NO: 517 - DNA, 255 bp, Homo sapiens
atactaggtcgtgctaggggcagcgtgaccagccagggcggagagaggatgcttaactccttaggctcgaactcctcccttcctacccacctctctcccttctcgttcgggtattcaggacttccattccccagcccctgcctctccagctttctccttctgtcccataacccctgcgggtcccgggctggacttccagtccctgcggtagcgagcagctgagggttaagggggcggggctgctgcatttttggg

SEQ ID NO: 518 - DNA, 255 bp, Homo sapiens
gttcagggcggggccggtcggtgagtcagcggctctctgatccagcccgggagaggaccgagctggaggagctgggtgtggggtgcgttgggctggtggggaggcctagtttgggtgcaagtaggtctgattgagcttgtgttgtgctgaagggacagccctgggtctaggggagagagtccctgagtgtgagacccgccttccccggtcccagcccctcccagttcccccagggacggccacttcctggtcccc

SEQ ID NO: 519 - DNA, 255 bp, Homo sapiens
gagctacttgaagaccaattagagtccgggaagcgcggcggggcctccagaccggggcgggcttaagggtgacatctgcgctttaaagggtccgggtcagctgactcccgactctgtggagtctagctgccagggtcgcggcagctgcggggagagatgactggggagcgacccagcacggcgctcccggacagacgctgggggccgcggattctgggcttctggggaggctgtagggtttgggtgtttgccgcg

SEQ ID NO: 520 - DNA, 255 bp, Homo sapiens
gacgagggggcgggaactcgcgccgagacttcccgtctgtacaaagatggctgccacattggcgctgtcattttggtactgagcagagcgacgggcttaattcgacccaatccaggccagagtctttctctcaggggcttcctcgtgctcagctaatcctccgatcaatccttgggaatccctgggacctcttcggtatccctactctcagccagggatcatgtcttgggccgctcgcccgcccttcctccctca

SEQ ID NO: 521 - DNA, 255 bp, Homo sapiens
tccggggctagtttgtgtttcagacttccatatttccatttgcagttgggtgaagtggttagagctgaaaggggacagctggagtcaaacaacttaactcaaatatctgggaacgatttcgcgctgaggaagaccctttgggacttgtagctccactccggggaacggactcgccgggactgacagttgccggaagtgaggctgcggggaatggccgccgctgcgaccatggcggctgcggcccgggaactggtg

SEQ ID NO: 522 - DNA, 255 bp, Homo sapiens
agcctgccgcttccggctctggcggggggggcacgtgccccgtcccgttgccccggcgaccgcggcggtttgttctcaggccccggcctttctcaccgtgcgacgccccaacccgccgctccgccgcggtggtacgctccaggccgccaggccgcgaggcccaccgagcggacgccagtggatgacccgcggcgggggaggaggagataccatcagcaaaatgccagacgtcaaggagagtgtgcccccgaaata

SEQ ID NO: 523 - DNA, 255 bp, Homo sapiens
cccatcaccacagctggctctgtctcccgccacccacaccagctgtcccactcaccatggagaagatcctgatcctcctgcttgtcgccctctctgtggcctatgcagctcctggcccccgggggatcattatcaacctggctggagtgtagtggcacaatctcggctcactgcaatctctgcttcccgggttcaaatgattctcctgcctcagcctcccaagaagctgggattacaggagaacggtgagctctg

SEQ ID NO: 524 - DNA, 255 bp, Homo sapiens
cttcactccactgcgactgcagaactcagagctgctcttcctctgtggccagttggggaccagcatcatgaagtggatggtggtggtcttggtctgcctccagctcttggaggcagcagtggtcaaagtgcccctgaagaaatttaagtctatccgtgagaccatgaaggagaagggcttgctgggggagttcctgaggacccacaagtatgatcctgcttggaagtaccgctttggtgacctcagcgtgaccta

SEQ ID NO: 525 - DNA, 255 bp, Homo sapiens
ctgcggcggcgcgctccgagcctgcgtctagggcgcccccgggtcagagctgtcgccgtggccgccgctgcaagaaccatgtaccgcagcagcgctcgctcctccgtctcttcccaccggcctaaagacgacggcgggggcggcccgcgcagcggccgcagctctggctcctcctcaggcccggctcgccgcagctcaccgccgcctccgccctccggctcctcgtcgcggaccccggctcgccgaccccgctcg

SEQ ID NO: 526 - DNA, 255 bp, Homo sapiens
cccccgtccacgtccccagcttccggaagttgcttttgtccaaacatccgggcttctcctttttgtgttccggccgatcccacctctcctcgaccctggacgtctaccttccggaggcccacatcttgcccactccgcgcgcggggctagcgcgggtttcagcgacgggagccctcaagggacatggcaactacagcggcgccggcgggcggcgcccgaaatggagctggcccggaatggggagggttcgaagaa

SEQ ID NO: 527 - DNA, 255 bp, Homo sapiens
gcgtccgccgggctgggcctggcgcgcaggcgctaggaagaggccgcgtggggcgaaggcggcgcttggctggtggggcccgcggcgggattttcccgggcggcgagagcggatctatcttgggatcccatggctttctttactgggctctggggccccttcacctgtgtaagcagagtgctgagccatcactgtttcagcaccactgggagtctgagtgcgattcagaagatgacgcgggtacgagtggtggac

SEQ ID NO: 528 - DNA, 255 bp, Homo sapiens
ggaaaaccggcctgactggggggtgaattcagcagggagtaaatctgatcggcatcaggtctgcggaaaggagctggtgagcacgacaccacccaggcattgcctggctctctccgcggcgggctaagttaaccgcgggtccaggagactaagctgaaactgctgctcagctcccaagatggtgccacccaaattgcatgtgcttttctgcctctgcggctgcctggctgtggtttatccttttgactggcaata

SEQ ID NO: 529 - DNA, 255 bp, Homo sapiens
acatttggctgggacacaaacgagttaggtgagttatagtctaacgtgagtgagttacctgcgtggtggctgcaggctgagctctaaccagataacatgtccacggattcttgacagagagaaataagatcacttagaaagaaaggatcatttctcccttgagtcacaaggagacagaaacagaaaaaaaagcacaaaagctatgctgctccaatcaaaactgaaaatgcttttaatgtctgagcaatcttaaga

SEQ ID NO: 530 - DNA, 255 bp, Homo sapiens
gaacacaggcatacacaggaagatacattcacagaaagagcttcctgcacaaagtaagccaccagcgcaacatgacagtgaagaccctgcatggcccagccatggtcaagtacttgctgctgtcgatattggggcttgcctttctgagtgaggcggcagctcggaaaatccccaaagtaggacatacttttttccaaaagcctgagagttgcccgcctgtgccaggaggtagtatgaagcttgacattggcatca

SEQ ID NO: 531 - DNA, 255 bp, Homo sapiens
atggaggaaccgggtgctcagtgcgctccaccgccgcccgcgggctccgagacctgggttcctcaagccaacttatcctctgctccctcccaaaactgcagcgccaaggactacatttaccaggactccatctccctaccctggaaagtactgctggttatgctattggcgctcatcaccttggccaccacgctctccaatgcctttgtgattgccacagtgtaccggacccggaaactgcacaccccggctaac

SEQ ID NO: 532 - DNA, 255 bp, Homo sapiens
ggccagccttgccctcacagcccctcagagcagcccgtcaggaggcagcagatggatcaatggtcaagccaggggggatttgctctgccacaggctactggaaagcagctttttgcctcacagatgtccacaaaatgccttattttacaagactcattttgttcttgttttgcttgatggttctcgtggagagcagaaaacccaagaggaagcgatggacagggcaggtggaaatgcccaagccaagtcacttat

SEQ ID NO: 533 - DNA, 255 bp, Homo sapiens
gcggccgcggcagggctgggcctgcgactacccgaggaggctgacctccagcccgggcgcccggttcagcgccgccccggccggcgccggtgcctgccaggcactcagggaggcgggggcgcagtggaggaggcggcgccatcgcgaagcgagcgcctcgcccgcactcagccttgccaccccgcccgcagtccaggctggactgggcggcatttgccgaggctcctcggccaggccccgtccgcccgagccgcg

SEQ ID NO: 534 - DNA, 255 bp, Homo sapiens
aaacagcgccgagccgccgccgcctcagcagcagcagcagcagcagcagcggcagcagcggccgtgcacgcccgggctgcggtcgcacagcgctaacgtgagcggccgccgccctcgccaccccgcctgcccactcccgccgccgccccgctctcgctttccccccggcctcccctcgccccttcccctcccccttcccggcgcactcggggggctgggaacgagctgccatgtgatgcgcgtcccctccgcgag

SEQ ID NO: 535 - DNA, 255 bp, Homo sapiens
aaagtttccgagtccattccgggagcgggagcccatcttgctggctgccgaggccctcgctggaggaggagggtcagaactcgggtgcagccaatcgagggcaacgctgctacttatcagagcagaatgggctgtagtttagtgaaataggaaagctgcaaaacactgtggagtgctcccgtgtaaataaaaagaggaaaaaagtttctcaagtcgccgctgcacgacgtctggccggcgctggagcgggggtct

SEQ ID NO: 536 - DNA, 255 bp, Homo sapiens
agcactcattggacttcagcatgactactcagttgccagcttacgtggcaattttgcttttctatgtctcaagagccagctgccaggacactttcactgcagctgtttatgagcatgcagcgatattgcccaatgccaccctaacaccagtgtctcgtgaggaggctttggcattaatgaatcggaatctggacattttggaaggagcgatcacatcagcagcagatcagggtgcgcatattattgtgactccag

SEQ ID NO: 537 - DNA, 255 bp, Homo sapiens
ccgatattgaactttaactgaccatcagaccggcctgaataccagaatctctttgcaatgcactcgcctcgctcattaccagaaggaggttttacctgcctagtgacctggttggtctgggcatgaaccccgagaggtggaaactctcagactctcaggactgacagccgagtggctggggactataaatccgcgagaactgccctcgcgctgccatccagctgggtagccgggggagcgcgcgtgggggctccg

SEQ ID NO: 538 - DNA, 2002 bp, Homo sapiens
tggcttgaattaagatgacaaaggtagagatggggagaggtggatgaacttgagagctatttcaaggataaaatctaaacgcataccctggagttcagggacgtggattaggacaccctactggatcccatggagaaggatgattcaagggatatctccctgggggggtgtggttcttgtttgtggacccactggtttatttaccagaacatggctcttctatgctatcgtttttgcatcttgggtcaaaagacaacaaggttgctgaccaggtggcctctggtctggcatcctctggccaggcgggtcctgctgcacttgactgagaaagctggccgctcggactactgctacatttggttgaaatttctttttctttgtaacctagtaatgcaatatacctggaggtccatttatattattaagcttttaatacatttcataagtaatatcctacttactgaaaacatttactgtttaggattttcattagatcacttggataaatgcagaattcccttaaagttgacaacaatgaggaaacttacaaaacaagtgatttgtcaaaagctgaaatctgaaaaattatgttagttttggaggtctaggtaattaatacggtttggaaatagaggatcttagtgggttataagcacagtatatattcatgaatcgggctttctgggaagatgtgccacacactcaacagacctgatttcctttcttcctgcgactgcatttcccagcctcccctgcagctaggtaagatcatgtaatggaattctggccaatggaatatgagtggagttaatgtgggtaacctccatgatgggcaaagaaacacctcccaggaaaaagtcttgatttttcctcatgtctgctgactacatatcgactcttgaatagacttgagtatctgctgttgaaggatgcagaggctctgtcagcctgggcccctgagtgacttcatggagtataccatctctccaactggattttatctttcagtggttcagtttttctccactgtttccaccaaaataccatcaacagtaaggaagaacaatgtggaccaccagaaggctggagtgttttctgaagctgctcctgcttggactttggttggaagtcgtgattgtctgagggttcatgctggcgctcccccagtgaacctagctcacctaccctctgctctggctctagtctctcttcccttcttctaagggaggctactgctgtgctcagtgcggagctgggttcaaggagagctggggctctgaaggagtcgtggggagaaggctgacatgagtcctgagtgagtggacctgctctctctggccctgaaggggtcaagaggcaactgggtgtgtgggctgagtctttcctggccctgaagctggaagtagaggctttgtgcaggatcctcagcaggggactaaaagcctgtgctttcataacccgagccacactggcaagtgcgctgcctcctcccacctttgagacagttgccttcaggagcacatctaccagaagccaacaaagaaaagcaacagcctcttggaggggcctttctccagggagagaagggtgaggcagcacaggcagagctggtgtaggagacacaagacagtatgaatttcaaaatcagagcattgaaggagattcaaatatggcacaaaaagagtttctggagctaaaaatcataatttcctaactaaataccattcagtagattaactgaaaaagtggaagatcaccgtgaagatatggtcagctctcctggagggtcaaagggcagacagaccccttgatgaaaagggtggtatagagcaaatgtagaaagagatgggaagcaagtagaaatgggtaaggaacatgggatggatcctaaaaccttgacttgtgaatagagaaaccttgacttgcagaaagaggaaaaaatagaaccaacggaggagaggtgaccatgatactaacaataaaagaaaacttccctgaactg

SEQ ID NO: 539 - DNA, 255 bp, Homo sapiens
ggaggacacttctcagaaggggttgttttgcttttgcttatttccgtccatttccctctctgcgcgcggaccttccttttccagatggtgagagccgcggggacacccgacgccggggcaggctgatccacgatcctgggtgtgcgtaacgccgcctggggctccgtgggcgagggacgtgtggggacaggtgcaccggaaactgccagactggagagttgaggcatcggaggcgcgagaacagcactactactg

SEQ ID NO: 540 - DNA, 255 bp, Homo sapiens
gcggagaaggaggcggagggagcgattgtggccccggccgcggtggccggcgcggcctgccctttgtgaccgcagctcgcgccccacgccccgcgcccatggccgccgtgccgggctccctggccacgcgtgcccgcccgcggacctgagccccgcgcctgggatgccggggatgcgcgtcccccggccctgcggctgctccgggctgggcgcggggcgatggacctgagcatgaagaagttcgccgtgcgcagg

SEQ ID NO: 541 - DNA, 255 bp, Homo sapiens
gttggggagcacgagggggtggctcgaggcgggagcgaggggcaggaagaaatagcaggaagacccaggggcaggaggccggtgttcaagcgtcgaggaacgtttcatcccttctgaatcccaggcctcgctggaccacggacccgccaggttctcccgcaacttgcggagctcctggaccggcccttcccagaggcgcagcgctgagtcccaggagcaggacctgaaccaggaaggggaggggcgagcacagtc

SEQ ID NO: 542 - DNA, 255 bp, Homo sapiens
tatggtttgaagtggtgaacatggatttttctcggcttcacatgtacagtcctccccagtgtgtgccggagaacacgggctacacgtatgcgctcagttccagctattcttcagatgctctggattttgagacggagcacaaattggaccctgtatttgattctccacggatgtcccgccgtagtttgcgcctggccacgacagcatgcaccctgggggatggtgaggctgtgggtgccgacagcggcaccagca

SEQ ID NO: 543 - DNA, 255 bp, Homo sapiens
gggcactaactcaagctcccctggagcgcagtcactttacaaccaccttcctccccaaatgccagcatggacaaattagatccagaagccctgcacacagccatcctcagggagaaagcacagttggctgggccttgattcacgaagggggcctgccccatgccacggcggtccctcctggcacccgcctcctgataaccctcgtgctgtgtcgataccacagatcctgttccgggccaaagacctggatcccga

SEQ ID NO: 544 - DNA, 255 bp, Homo sapiens
gatgtcacgagcccgcaggaagtctcgtatcgcgcccgggaggcgccggagcccagcggctggcgccagatccaggctcctggaagaaccatgtccggcagctactggtcatgccaggcacacactgctgcccaagaggagctgctgtttgaattatctgtgaatgttgggaagaggaatgccagagctgccggctgaaaattacccaaccaagagaaatctgcaggatggactttctggtcctcttcttgttct

SEQ ID NO: 545 - DNA, 255 bp, Homo sapiens
gcggcggcaggcgggcaagcgggcgggtgccgcagcccaggcccgggtcgcgcctctttgtttccacgggtagcggcgcagtcccgggccccgggcggaagtgagacgcgctcggcgcgggggccgcggcggccgcaccatgagcgacatccgccactcgctgctgcgccgcgatgcgctgagcgccgccaaggaggtgttgtaccacctggacatctacttcagcagccagctgcagagcgcgccgctgcccat

SEQ ID NO: 546 - DNA, 255 bp, Homo sapiens
ggtcctgggcgctgggaggcggtgccgggggcggggtgcggctggggcgaattagttgccattcggagtgaggagtgggtagaagcggcggcggcggcggcggcgtttgcggtggcgcggactccgaggagcgccagcacctcgaggccctttctctctaccctggtccccagaagcaggggtcccggccctccttgcagctgccgggttctcccgtgcgtgcagccctgcgagggctgaggagaaggctgcgag

SEQ ID NO: 547 - DNA, 255 bp, Homo sapiens
tgccgcttaataccatcacatgatcctccccgaggccctgtatttaattaaaatagagagggaggcaccacagatgccagaagaacactgttgctcttggtggacgggcccagaggaattcagagttaaaccttgagtgcctgcgtccgtgagaattcagcatggaatgtctctactatttcctgggatttctgctcctggctgcaagattgccacttgatgccgccaaacgatttcatgatgtgctgggcaatg

SEQ ID NO: 548 - DNA, 255 bp, Homo sapiens
agggaggcggagcggaagccgagtgcgagggacgagcggagtaaaatctccacaagctgggaacaaacctcgtcccaactcccacccaccggcgtttctccagctcgatctggaggctgcttcgccagtgtgggacgcagctgacgcccgcttattagctctcgctgcgtcgccccggctcagaagctccgtggcggcggcgaccgtgacgagaagcccacggccagctcagttctcttctactttgggagagag

SEQ ID NO: 549 - DNA, 255 bp, Homo sapiens
tcggcggtagcggcgccgcttggagcacgggcgctgcgggacggagcccggagccggaggcggcggcggcggagacgtcggccggagctcgagtccagtccagcccccggctccgccacctgcagagcagaagccactctcttgggaccattcataagcaggagacatcaacaccgtgacacatgccagtgccaccgccacccccacctcctctgcctccacctcccccgcctctgggggctcctccccctcccc

SEQ ID NO: 550 - DNA, 255 bp, Homo sapiens
atgcctggccacaatacctccaggaattcctcttgcgatcctatagtgacaccccacttaatcagcctctacttcatagtgcttattggcgggctggtgggtgtcatttccattcttttcctcctggtgaaaatgaacacccggtcagtgaccaccatggcggtcattaacttggtggtggtccacagcgtttttctgctgacagtgccatttcgcttgacctacctcatcaagaagacttggatgtttgggctg

SEQ ID NO: 551 - DNA, 255 bp, Homo sapiens
ccggggcgcgaccgcggatccgcagttcccgggccagcctggggcggccggccaggaaccacccgttaagatggaatcactgaattcatcacttgacacagtactagtttggataagtttagcaaggtgtcttctctttagggatggtgaggttggaaaaaggctcctgtaaccctcctccaggatgaaccacctgccagaagacatggagaacgctctcaccgggagccagagctcccatgcttctctgcgcaa

SEQ ID NO: 552 - DNA, 255 bp, Homo sapiens
atctctcagcgcagcaggacacggggaccatgcaagctgtaattggtcaggcatgaactctcttgggttgtgttaccctgtttgctgtttactgtcaagatgctgaaagaatgttcttataatgatccaagaggaagtggcaaatgagtgctcttcttcaggatccaatgatagctggacaagtcagtaagcccttgctgtcagtgcggagtgaaatgaatgcggagttgagaggtgaggacaaggctgctactt

SEQ ID NO: 553 - DNA, 255 bp, Homo sapiens
gcatctggtgttttcgctgccgaggataggacgacgagcgcaatcgggagctccgccgcccggattcctgcttccctggggcccggaggctgctgcgtaccccactgtgacctggaacccagggacccgagtcccgacccggattatcgtggcgcttttcccggccggctctggtgctcggtgtccctccgccgccgctcccgtttccggcgggggagatggccaggatctgacccgggaggaggccgcacccgc

SEQ ID NO: 554 - DNA, 255 bp, Homo sapiens
cgcatggagcggcgcgggccgggggccgccacggcgaggggccgggccaggccgggcggagccagagcagctgagttccagataaaaactgtcagacccggcctgtaggctgctccattgccaatgaactccatgaaccccatgaaacctgccctgccccctgcgccacacggtgatggttcattcgcatatgagtctgtgccttggcaacaaagcgccactcagccggctggatcgctgtctgtggtcactact

SEQ ID NO: 555 - DNA, 255 bp, Homo sapiens
ggtcagctgagttcgccggcccagggcaggcggggcccgagcctagcggtaacccccgggcagggcggggccgctcgcagactccatatgagattcacctcgcaggtggttccctcattcgagtgctccggcgcacagacccgcgccccgccgtctgcgagcctcccgagagccgtcccttcgtccggccctggagcattgcgtttgtcgccggtgtcgcagtgcgaggatggcgccgcgggtgtagcggctctc

SEQ ID NO: 556 - DNA, 255 bp, Homo sapiens
aggacggcttccgggatttggcggggcctttgtctctcgctgcagtcgcagctccaggtctcgtcttcactgctctatgtcctctgctcctagaggtccaccttctgtggccccgttacctgcaggtattgggagatccacagctaagacgccaggactccctggaagcctagaaatggccagaaaaactgggaaaatcacaggctcttccacttactggatgtttgacaaaatattcttcttgggccaaaaaca

SEQ ID NO: 557 - DNA, 255 bp, Homo sapiens
agctgggcgcgagcgggtcggcgttgagggagccaccgccctcccgcctgcgcactgcctctcgcccccctccggccagcccgcagccggccgcgtcatgccaggcgctgctcggcggtagggagtgcccggggccgccgcctccgcccgcccgaagccgcgcccactgcccagagccagagggatggtggtagtcacggggcgggagccagacagccgtcgtcaggacggtgccatgtccagctctgacgccga

SEQ ID NO: 558 - DNA, 255 bp, Homo sapiens
aacgtgcgttcgctggcggtgccgggggcggggcgagcaggagggtgggtgtgaggcgggagctggccgcggagcccagacctacccgggcgaagcgggcgagcggtggtttggacgccggcggagacgcgggcgagtggttagcaggaagaagatgagccttaagtctgaacgccgaggaattcatgtggatcaatcggatctcctgtgcaagaaaggatgtggttactacggcaaccctgcctggcagggttt

SEQ ID NO: 559 - DNA, 255 bp, Homo sapiens
aggataccctgggtcggctcctccacgtgaccacccactatggcttcctagtgtcagggccagctgtgtagtggctcggtgtgatttgttagctctttgaggcagggtaccctcctcaggatttcgatatgcaaaaaatcaaatctctcatgacccgacagggtctgaaaagccctcaagaaagcctcagtgatcttggtgccatagagagtctccgggtccctggaaaggaagaattcagggaacttcgagaac

SEQ ID NO: 560 - DNA, 255 bp, Homo sapiens
gggcagaggactgctgtttgctgacacaatcttggtgcgttggaagtgaaagggaagaggcactggtggctgtgctttgggcccgagcagccagaagccagttgccatcacctatgacgaggagacagcgcctggggcagagcccagtatggggcctagccagggctgggttctcacccacctgtgccgccctgccttgttacctggaagcacagccttggggactgagcaggccctcactgtcactttaagaag

SEQ ID NO: 561 - DNA, 255 bp, Homo sapiens
aatcagagcacaccggactgcgttttttccgaacgccagcagcagggtcagaagggaggtagtcgccctccgtcgtggcctggcgtggattccgagcgttggtgtctggcggtttccgaccgttggtgtctggcacgcgccaccccgatgtaccaggtaaagccctatcacggggtcggcgcccctctccgtgtggagcccacctgcatgtactggctccccaacatgcacggcaggagcggcggcccagcactc

SEQ ID NO: 562 - DNA, 255 bp, Homo sapiens
gtctctgtctctcctcctccctcctcctgctccgggcggagcccggcatgggggggccggcgcccggcaggccagtggatccgggacccagggagggccgccccccgggcctggtggcactgagcagggccccccagcccccacctcctgccccacgagatgaacctcctctaccgaaaaaccaagctggagtggaggcagcacaaggaagaggaggccaagaggagctccagtaaggaggtggcccccgctggc

SEQ ID NO: 563 - DNA, 255 bp, Homo sapiens
actggcgggcgggatccctccgctctggggaggcagcgctggcggcggggctggggccactgaggaaatccatccgcgccgccgccgccgccgccgccgccgccgccgccgcctccgccgcggaggaagacagcgccgcccgcgcaccgccagcgacctccgccgcagagtcccaccgccacaggcctcgggccagcggccaggagctgcctcccccagcccccgtcccgcggcccccagccgcccccaaccctg

SEQ ID NO: 564 - DNA, 255 bp, Homo sapiens
gaaggaagccaagagcctataatagcgatcctggggaaaatttcagcagctggggccatgtaatttaaaacctctgaaaagtgtgctgcggtccgtgcacagcattagtataacgtgagggctgaatgcagcccattctctggagaacttcctcacacaccgcagcaaagagaagactgaaagacaaacctgggtgcagccagagaggtccagatagatgagcttgtggcatccattccccaagttcagcctagg

SEQ ID NO: 565 - DNA, 255 bp, Homo sapiens
tttcagccaaccagactggagcagctgcgagtgctacatcttggctgtctgaagcgattggctcctctctggggagtggagggtgttcagttattaatgaccgctgagcaggcagcaccatgtcagtgtgacaactgatcgggtgaacgatgcaccactaaccaccatggaaacaaggaaaaataaagccagctcacaggatctctcttcactggattgagagcctcagcctgccgactgagaaaaagagttcca

SEQ ID NO: 566 - DNA, 255 bp, Homo sapiens
aattggaagcaaatgacatcacagcaggtcagagaaaaagggttgagcggcaggcacccagagtagtaggtctttggcattaggagcttgagcccagacggccctagcagggaccccagcgcccgagagaccatgcagaggtcgcctctggaaaaggccagcgttgtctccaaactttttttcagctggaccagaccaattttgaggaaaggatacagacagcgcctggaattgtcagacatataccaaatccct

SEQ ID NO: 567 - DNA, 255 bp, Homo sapiens
gtcaccgctgtgcggcttctgtttggttggccagttcgtcccaatttccgactcacagggctgcggagcagcaactctcacgatatttgctgcgacccgcaggcgctatccgctgccgggttctggcgcgccctttcagttctgcttgctgtcggcaccgctgcgttacccggaaccgccgggccgaacagcatgacgtccgctttggagaactacatcaaccgaactgttgccgttattacatcagatgggaga

SEQ ID NO: 568 - DNA, 255 bp, Homo sapiens
agttggtggagcccccgcgggaaacgactgagcgcgaggagcgtgcgcgctcccgtcgtggcgacggtggcggcgagcggcgtcagagcttgagggggggttgacggcttctggcgggtggcggtgttgaaggcgagagcttgcttggcccgtgtcgcttctgtcccaagaaccggacggagagtgagggcacgagggtcgctgtcgggggctgtcgtcttccacgtacacgtcgtcgtgaggagcgcagtccgg

SEQ ID NO: 569 - DNA, 255 bp, Homo sapiens
attgctaagccatccttcagacagagagggagcggctgcaagaggtaatgagagatggcaagaaagaagctgaaaaaatttactactttggagattgtgctcagtgttcttctgcttgtgttgtttatcatcagtattgttctaattgtgcttttagccaaagagtcactgaaatcaacagccccagatcctgggacaactggtaccccagatcctgggacaactggtaccccagatcctggaacaactggtacc

SEQ ID NO: 570 - DNA, 255 bp, Homo sapiens
agacacttttaactcacagtaaaagcaaaagcaacagctcaagcagcctccttggagaaaacctgaaaattcaacttgttcaagagaaggtcttgtacgtgcctaagttctagagcctcctgacgtgagcatggctgagagtgaggaccgctccctgaggatcgttctggtagggaaaactggaagtgggaaaagtgcaacagcgaacaccatccttggagaggaaatctttgattctagaattgctgcccaagc

SEQ ID NO: 571 - DNA, 255 bp, Homo sapiens
cacgcccctgggcggtgcgcgcgggcggtgggtaggccgggcaggctcacgtgatgcgggccccgcggcccgccatataaacccgcgcgcccgccaggcgctgcggccgtcccgggccgtgactcctcctttcccccgccccgcctccgttcggagagccggcgggcgggcgcctctcggccaggaagcgcctcttggacgcgtgtgaccgatgcccagattgcacgaccacttctggagctgctcctgtgcgca

SEQ ID NO: 572 - DNA, 255 bp, Homo sapiens
aggagccgggcggaggtgactgccgcgtgtttgcgttgcacgcccaccgcccgaaacacggcggcggcctcagggctgctgcggcctcggcgggggcaggccccggcgcccgcccgcctcccggcctccatcatcccagggtgcaccgcggcgggcgcgggcgcgcggccatgttgcggtagtttgttgttttcttcctgcggaggcgaagggccagctgtggaccgcgaagcgcccggcttcgcctctgcctcc

SEQ ID NO: 573 - DNA, 255 bp, Homo sapiens
ttgtgacgcaaacgctatggccacgtggaacacctgccggagagcaggggcggggtcactctgggcggcggatccgagcgggggataccccaggagatgggggtcgaggagagaccccggggagtagagagagagaaactcactccccgagtccccgaccctccccaagcaaggttataatataacttatcctctcatgcttttttcctgccccttctccccaaatcatcaacaatagaagaagaagaaaacatg

SEQ ID NO: 574 - DNA, 255 bp, Homo sapiens
gggtccctggtcgtgcctgtcagagaggctggcggcagtggtggctctcccggctgggttgtcagtcagtgagaggagggggaagatggctcaccgggacccgttctgctaggaagaaggggagcaggtggtgctgctactcgggaggaagcagagcagcctccgtcgctgtcgctgagagcctcacgagtcgaggtcctgcaggtggagctccggcagccgccctggttgaaggtttagaacagatgtggaaaa

SEQ ID NO: 575 - DNA, 255 bp, Homo sapiens
gtaaagggattgacaggccctgccgcgtcaggccgctcctctcggctccgcgctccttccctcgcgcgtgggcacccgcccccgagcggtgagagcgcgtgcgcgcgcgcccttctccgtgggcgagccagccagtcccgctgcacacgctcgcagtctgtgggccctccgggaggcggcggaggtcaccgcggggagaggggcgggcgcagcatggcagcctccttacggctcctcggagctgcctccggtctc

SEQ ID NO: 576 - DNA, 255 bp, Homo sapiens
actcggctgggagaatccgcgccagggaatccagctctccggactcagctgcaaacaaaaagcgccgggtcttgctccctcctcccgcccgccgacgcgcacccggagaaacagttttatacagaaatgcaacaagtagtacccggggtctgcagagcgccccgcgccgcctgacttggccgggcgaagcccgcctgcagagacccgggccggcctccggacaaaggacggaggaggggctggacggcgctgcga

SEQ ID NO: 577 - DNA, 255 bp, Homo sapiens
agcgccgggagtctgggtagggggaagcgcccggcggccgcctccgccactgcagctgcagcccccgaggtcgccgcagtaatccggacccggcagcacccgcaccctcggcggccgcagcctcagcaccgcagagcggagagcggagcccggagcccgccgccccaggatggctgcagctcctccaagttactgttttgttgccttccctccacgtgctaaggatggtctggtggtatttgggaaaaattcagc

SEQ ID NO: 578 - DNA, 255 bp, Homo sapiens
aaaaattaaaaaaggatgtgaaaagatgctactcgcttttggcctcccggagatggcgctatgagggtgacggagttaattagtgcctccaaacgccgtgtgtgagctcatcgaagtcatgctctgcacacatattatttatagcagatctgaggcatgcatggtgtttgacatttctgtcttttaagtagggggacttcaaaaagtcgtgggcatccccctaggcaaagtgcagtgggcagggaccaggcaggg

SEQ ID NO: 579 - DNA, 255 bp, Homo sapiens
agtacagtataaaacttcacagtgccaataccatgaagaggagctcagacagctcttaccacatgatacaagagccggctggtggaagagtggggaccagaaagagaatttgctgaagaggagaaggaaaaaaaaaacaccaaaaaaaaaaataaaaaaatccacacacacaaaaaaacctgcgcgtgaggggggaggaaaagcagggccttttaaaaaggcaatcacaacaacttttgctgccaggatgccctt

SEQ ID NO: 580 - DNA, 255 bp, Homo sapiens
aggtgtgcggcgcgctcctggcgaggacggagcgagcagatctcgcgtgcgctcgccgcccggcgcagcccagcccggcccccgcctggcgccgcgagccgaggtgtctcccgcgcccgcgcccgtgtcgccgccgtgcccgcgagcgggagccggagtcgccgccgcccgagcgcagccgagcgcacgccgagcccgtccgccgccgccatggccaccacggtgacctgcacccgcttcaccgacgagtaccag

SEQ ID NO: 581 - DNA, 255 bp, Homo sapiens
cttggctgttcctgaggcctggcctggctccccgctgaccccttcccagacctgggatggcggaggccggcctgaggggctggctgctgtgggccctgctcctgcgcttggcccagagtgagccttacacaaccatccaccagcctggctactgcgccttctatgacgaatgtgggaagaacccagagctgtctggaagcctcatgacactctccaacgtgtcctgcctgtccaacacgccggcccgcaagatca

SEQ ID NO: 582 - DNA, 255 bp, Homo sapiens
aactgtcactgtggagaggagagagagaggacagagagcaagtcactcccggctgcctttttcacctctgacagagcccagacaccatgaacgcaagtgaattccgaaggagagggaaggagatggtggattacgtggccaactacatggaaggcattgagggacgccaggtctaccctgacgtggagcccgggtacctgcggccgctgatccctgccgctgcccctcaggagccagacacgtttgaggacatca

SEQ ID NO: 583 - DNA, 255 bp, Homo sapiens
gctttttgaccccggaagtccgggcgggcgccgagccgggtgcgttttgccacagagccgtaaaggcgcgcgggaacatggggctgtatgctgcagctgcaggcgtgttggccggcgtggagagccgccagggctctatcaaggggttggtgtactccagcaacttccagaacgtgaagcagctgtacgcgctggtgtgcgaaacgcagcgctactccgccgtgctggatgctgtgatcgccagcgccggcctcc

SEQ ID NO: 584 - DNA, 255 bp, Homo sapiens
agcccagtcgccgccgcccgcccacaaagccacaggcaggtgcaggcgcagccgcggcgagagcgtatggagccgagccgttagcgcgcgccgtcggtgagtcagtccgtccgtccgtccgtccgtcggggcgccgcagctcccgccaggcccagcggccccggcccctcgtctccccgcacccggagccacccggtggagcgggccttgccgcggcagccatgtccatgggcctggagatcacgggcaccgcgc

SEQ ID NO: 585 - DNA, 255 bp, Homo sapiens
cgaccactcgggttcggctatgcgggagccgtgaggaggaggcttgcagtcgtggacctgagacctcgggaggtcatgctgtcttgcttttaagtggcttggggaaagtgaagaaaccccaaaatggaggactttgctaccaggacctacggcaccagtggcctggacaacagacctctgtttggggagacgtccgccaaggatcgaatcatcaatttagttgttggcagcttaacatccttattgattctagta

SEQ ID NO: 586 - DNA, 255 bp, Homo sapiens
gcagggggcggagaggcctggcgcacagggcgagggcggctgcggcgcagtctgcagcatggcgtacccggggcatcctggcgccggcggcgggtactacccaggcgggtatggaggggctcccggagggcctgcgtttcccggacaaactcaggatccgctgtatggttactttgctgctgtagctggacaggatgggcagatagatgctgatgaattgcagagatgtctgacacagtctggcattgctggagg

SEQ ID NO: 587 - DNA, 255 bp, Homo sapiens
atccggcgcggtgtttagactccactgatgtcgtggcgctttaggggaagaagttggtgtttcgctgggccctggtactgaagacgcggtccgggtcgcccctagctgtttcctactcacccaaagccccgcacccgccttttctctctctcctctggcaggatgaggcgtgcaggcctgggtgaaggagtacctcctggcaactatgggaactatggctatgctaatagtgggtatagtgcctgtgaagaagaa

SEQ ID NO: 588 - DNA, 255 bp, Homo sapiens
agtcccgtcagcttccggtagaagagctcggccacatcccggccgccactgtccccgcggactggcgggtggaaggactcagtgaaggatcctgcgacacaggctggccctgggcgcccctcccgcccggcccctccgccccttcccagccccaagggtctaggatacagtctttgtagatgagcgggtcccccttggaggacagaatgaagaattgggaaatcatggccgttctggagagtagacaagaagacg

SEQ ID NO: 589 - DNA, 255 bp, Homo sapiens
ggcaagttgtttgttacagcgaacaccagctgctccccgcgccggcacccgcgcgccgctgctccgccggcgctgcctccctcgacccgtggctccccctcgcaacttggcgggcctcctcccttttgtccggcccggtccggccgccgccgccccccgcgcctggcgccgagctcccgggtccccgggccggctgtcggtgccggcagggcgcggagggggcgggggccgcggctcgtcccccagcggatgagc

SEQ ID NO: 590 - DNA, 255 bp, Homo sapiens
aacactcaatgtcggaacgttccgaagatgacgtcggagcgttctcgaatcccgtgtctctcggctgctgctgccgaaggaacagggaaaaagcaacaagaaggaagagcaatggcgacactggatcgcaaagtgcccagtccggaggcgtttctgggcaaaccctggtcctcctggatcgacgccgccaaattacactgctccgacaatgtagatttagaagaggctggaaaagagggtggaaaaagcagggag

SEQ ID NO: 591 - DNA, 255 bp, Homo sapiens
gacccgagagccgctgagccgcgaggccgggccggggcgccggccgggaatgccgggggcgcggcgccgacgccgaggcgcggccatggaggggaagccccgcgccggggtcgcgctggccccggggccgagcggccgacggccttccgcccgctgcgcccgccgccgccgcccggggctgctgcttcctggcctctggctgctgctgctggcccggccggcctcgtgcgccccagatgagctctctccggaaca

SEQ ID NO: 592 - DNA, 255 bp, Homo sapiens
aggggtgagctggcggcgggggaggcgggcagcggagccaagctgacccggcgagcggagccggggctggagagcggcgaccactgcggatctcggaaggaagaaatgatgtaaatcactcatccaaaccttaaggtcaaaggtgagaaggaaggtcaggaagaacatggcctggccaaatgtttttcaaagagggtctctgctgtcccagttcagccatcatcatgttgtagtgttcctgctcactttcttcag

SEQ ID NO: 593 - DNA, 255 bp, Homo sapiens
gtgcgcgcccacgtgcatgcgcgtgtgtggtcctagtgtaggtgatgtctgcggccacacaggatgctgactgcgtgtgtgactcgtgggcgtgcagatgcaagcacaggcctacgacacatctgtgtacaggctgaagatcacaacgggtctggccagggcccgccgagggcctccgagctggcgagcacaccgacggctggatggggcgacgcttcctgctccggtccctaactcattattaagctcctcgct

SEQ ID NO: 594 - DNA, 255 bp, Homo sapiens
gaggtgcgcgcgcccgcgccgatgtgtgtgagtgcgtgtcctgctcgctccatgttgccgcctctcccggtacctgctgctgctcccggggctgcgggaaatgcgagaggctgagccggggaggaggaacccgagcagcagcggcggcggcggcggccgcggcggcgggagccccccaggaggaggaccgggatccatgtgtctttcctggtgactaggatgtcgtcggaggaggacaagagcgtggagcagccg

SEQ ID NO: 595 - DNA, 255 bp, Homo sapiens
ctctcgtagcgacgcccccaggggggcagaacgcgtgcgcacgcgcgtgcgaacgcgcgtgcgcgggcggtgtttgaggccggccagtcgtgactgggcggcaatgaggtcagtgactgccgggagtcctgcaggggcggggcggcgccaagcgcagggagcccggctgagtggcagcccagattgaagatggatacgtgacaatcccagggaccgctgcactgacttcatttccttagacaagacacagtgtag

SEQ ID NO: 596 - DNA, 255 bp, Homo sapiens
cagccggtacggccccgggtttgggcaacctcgattacgggcggcctccagccccgccagcagcgccccgcgcccgcccgcccgcgcccctgccgccccccggttccggccgcggaccccactctctgccgttccggctgcggctccgctgccggtagcgccgtcccccgggaccacccttcggctggcgccctcccatgctctcggccacccggagggcttgccagctcctcctcctccacagcctctttcccg

SEQ ID NO: 597 - DNA, 255 bp, Homo sapiens
gaaattggccctggagcatgtgggccccggggcgtgggttgagctcggtcttcccctgaggccgcgcggagctgggcgactggggcgaggactcgcgcacaggtaattaaccagaacaggatcgacacgtgttctctacagcccgtccatggatcctttccgaccatcgttcaggggccagtctcctatccacccatcccagtgccaggctgtacggatgccaggctgttggccacaagcttctaaacctttgga

SEQ ID NO: 598 - DNA, 255 bp, Homo sapiens
gtgcccaggcgccctctccgccgcgctccctggtggccgctcgctagagcacgcgcgccgcagacctagggtatttgcggatcagcgtcctcgcccatctcatcctccacactccgcccccacccacctgccccagctgctaagggtcttgacctttttcagaaacgtgcatcttttccagttctaattttgcacgcttgcacgtttaaagcaggagggatgaattcggtagtggataaatcagcaactttagga

SEQ ID NO: 599 - DNA, 255 bp, Homo sapiens
attccaagtccagcaagttcgcagggagctgtcagtccgtccaggaaggcccgggcctgggtttgcctcttcaagcagctactgcaggggcgtggggagggggcataagagactttggactttcctttgagacagtagaaagcgttacatccagaggcgagattctagcctggggtccccgccttcccggcctcctcttcctctccctctgactccctttcctgtgcccctccccctgcctctttcccggccaga

SEQ ID NO: 600 - DNA, 255 bp, Homo sapiens
gcgcacttccgggtgttgtctggccgccgtagcgcgtcttgggtctcccggctgccgctgctgccgccgccgcctcgggtcgtggagccaggagcgacgtcaccgccatggcaggcatcaaagctttgattagtttgtcctttggaggagcaatcggactgatgtttttgatgcttggatgtgcccttccaatatacaacaaatactggcccctctttgttctatttttttacatcctttcacctattccatact

SEQ ID NO: 601 - DNA, 255 bp, Homo sapiens
cgcgatccgaccggaagttgcacgctgagccgcggacaccatgcagtcggatgatgttatctgggatacactaggaaacaagcaattttgttccttcaaaataagaaccaagactcagagcttctgccgaaatgaatatagcctgactggactgtgtaatcggtcatcctgtcccctggcaaatagtcagtatgccactattaaagaagagaaaggacagtgctacttgtatatgaaggttatagaacgagcggc

SEQ ID NO: 602 - DNA, 255 bp, Homo sapiens
atacccaatcagcggccttcaggcgcagatcgtgggcggagcggtagccaggccgcgggccggccaatcagcgggcgagcggctgcctcagcgcgcgcggcgggcggggcggggcctgtccgcgcctaggagcagtgggcgctgagagcagcaaggccagggagggctatcttcaggctcatgcaggaggggaagattgggcctggtcttgaaagatggagttgaaaacttacagagtcctgaggctttcagact

SEQ ID NO: 603 - DNA, 255 bp, Homo sapiens
gggaggggcggggcctccgccaccacctcagctgcggaccgaggcgagatggcggccaccgagggggtcggggaggctgcgcaagggggcgagcccgggcagccggcgcaacccccgccccagccgcacccaccgccgccccagcagcagcacaaggaagagatggcggccgaggctggggaagccgtggcgtcccccatggacgacgggtttgtgagcctggactcgccctcctatgtcctgtacagttagaga

SEQ ID NO: 604 - DNA, 255 bp, Homo sapiens
agtaggcccagtgcgtgctggcccggggtggcaggagccgcagaggcttgggctgcagaaaaaggatcctgtttgctgtgtaatcctgagaatggactgcaagagaggaaaaactgggcgtctgcttgggaatctattgtggaaacccagggtgtttcccgaccagtccctgggcgccaactagagtatggactgaccaggtacctggatggagacctgagctggagaaggagatgcgcttgggaggaaattgca

SEQ ID NO: 605 - DNA, 255 bp, Homo sapiens
cgcgtcgggctgcaggagaagatggcggtctccacaggagttaaagttcctcgtaattttcgcttgttggaagaacttgaagaaggacaaaaaggagtaggcgacggtacagttagctggggccttgaagatgatgaagatatgacacttacaaggtggacaggcatgattattgggccaccaaggacaaattatgaaaacagaatatatagcctgaaagtagaatgtggacctaaatacccagaagctcctccg

SEQ ID NO: 606 - DNA, 3678 bp, Homo sapiens
agcccacgttcactattgaacacaacggaagggggaattattgtgcttcttgctttgattcccaagctggtgttgtctgagcctgtctggcatgtgctctgcctgccctgacttctgaccccaggaggagcattcaaggagccaaggaatgggtccaggcattgtgctagtatctagccatggcaagatgctagatctaaccatgacgagagcagctaagatcggactgtacctgagtgagcccattgaatcctccaccagcaccacacggggtttctattgtttgtctcagctgcagcaacataatatgagacaagggccaagaactgcagaactgtgcacggtgtttagaagaggctgcgagctgctgctctgcagagttgggaggtgctttcgggctctgcaggctccctgcaggcccttgctgactgtccatggcctgcacctgccctacctgctgagctgccccatcagctgctcctggctgtggtttcctgaggggtcccgtctgcatcggctgccctgtgtcctgacactatggtgggtttgcaagtggcaaagtccagggaaggagactggggagcatggccatgggtcatccggggggcacggagggttccggctcccgcccaggtccacctgcttcatcagcagtggtcaccaagattgcataaccaggacgatgacaacgctgagagctctgttgcagttaaagacttaagaacaacttgtgcctgctgactaatacattttatcacccaggcagcgtcaggactctgagagcctctcacatgctgctgtcatctgagcgagacctcaagatttgtcatcgagcaggctgacccttgcctgaatggacctcacattcttgaggcagggagagatctgcaatcagcatgatcgatcagcgattttcataagacgttagaagtcatcagagcttaggaaacagggtgaggaagtaggggaggagccggaagggcccccatttaaaacaaggtggccaggataggcctctctgtaggggtgacattgaagaaatggtgggagagggtgtgaggtgcacatctctgagggcagagtgttctggagacaggaaaccatctgtgcaaaggccctgtggtgagagggtgctaggagctagcaagcccagtctactcaacacagccatcattttaaaacctcggtgagccctgtcccttatcttctgaaccccctcccacagaagcggatgtcactgagagtgaaagctgcagtgtagggtggcctcctctgcacaccggccctggccctctgacctcttctaccccatgatggtcccctgtcagctgggtctagagtggaccgtcggggcagacctggaaggggaaggctgtcaagttcctgctcccctgtgacatacagcaacacatttgtttccccctggattctggggatcagcaacatgtgcgggtgggggcagggcagtcctgctgctctgggatgggctgccccctcagggaggactggccagctgggtggctctgctcctggagagtgaccggccatttgctgggtggatggggtgactgtcctgagagcttggcaccaccagaagtgtagtccacgcagcccttcacaggtggctcagggtgcccagcggggcaagaggtggccctcaagctaagcttgagcttaagcctaagcctaagcttgccacgcttgggctaggatgccaagtctccatgctggctgctggtcacagctctgtccctgtgggagaagacgactgaagcctggccaggctgggccatctccccagcagccaccagggcttgctgtgagatgtgggagccatgctagggtcctgccccggggatgttggtaggcatggtgggaagcagtgcaattatggatattttctggagataatcatcaacaggatttgctgatggaatggacctggaatacaagaagaaaaggaatcaaggatggctctgaggttcggggcttgagcaacttggatgggggtgctgctgagtcaggtgggaggggagcaggctcaggggatgcggactccatttgaagtggccgcgttggagatgtctgtggacatccacgtgaaatgctgagtggccagctggacatgtggatctggtgtccagggggaagtttgggctgcagatacagatttcaccaggacatatttttagtgatgcatagactgaccaggctcgaaagaagcacagggtgtgcagccccattctggtaagcgtgtctctgcctttactgaggtgtctccactgcatccttgatttaatggaattcaactgaaccatcattgagcatctgttgtatacgatgtactctggaggcataaaaactattgggagaaatgaggaagtaaataagtaatattgatataattcttctattaataagaatcaatttatctgaaaacaaaaagtctcttaagcatttgaataaaatagaaagcctttattaacatatgaaaataaatccatacccataaataaaaatctgcacactcacgggtgctgaccagtatatcctagctcaccagcacagtgggctgggtgtggagaaggtgggcattcagctttcacatcaggcagagggagccttggagcggagggtgctggctcaggactgctggccaagcccatggtggagtcaggccggcctgcagttggacactcttgactgattaaacattaataggcaattctaacaaaaacagagaggatggcaactccataggaaggagggccacatgtgggggtgaattccaagtcaaacattttccccaaagaatttgttgttaaacttttaattttgagataactgaagattcacatgtagtggtcagatataatatagcatgatcttctgtgccttttacccagttttctccgtcataacatctgcaaacgtagcactatattacagtatctcaaccagtgtataaatgcatacactcaccagtgtcactggggttcctccagtctcagttcatttgtgtgcatttattttccgtaactgtatcactgctgtagagtaggatggccaccttgacagtcaagaggcagaacagctccacacgagggttcctgtcttccttgctcctggaaccattaatctgctctccgtctctacaattttatcctttgagactgttacataaacaaaaccacacagtaacctcacaaggcatttttgcactcagtaaaatgcccttgagacccattcacgttgctgtgtgtatcagagcccgttcctttccatagctgagccgtgttcctggtgtggacacaccactgtttaatcagtcatcgtcgaaggacggctgccttgtcccccattttcgaccattacaaatgaagcttccatgagcattcatgtacaagtttctttgtgaacttaagctttcaagaaattaaaaaagaaatgttttcaaatgcttgagcaaatagccaagatcccagggcaccgtgggaaagtgtggaagtgaggattttttttttttttttgagatggagccttgctctgcactccagcctcggggtcaagagcgaaactctgtctcaaacaaaaagaaagaaaggaaggaaggaaggagggaaggaaggaaggaaagagagaaagaaaagaaagaaagaaagaaagaaagaaagaaag

SEQ ID NO: 607 - DNA, 255 bp, Homo sapiens
ttaggggctcccgtccccttacttcagcaccagaggggatggacagcgtctccggactgagctgcagccacagggacggaactacgctgccgccgccgctgtccttgccgccactgtcgtcgccacgggcagctgggctacttgctcctcgcagctaaaaggcggtgcctcctattaccccctcgcctcccggcccccttccttaatggatgaaaagtacccctccctctacacctgctgtacctaaggacagga

SEQ ID NO: 608 - DNA, 255 bp, Homo sapiens
tcctgtcactggcttatatggacacgtcagcccaccgtcacgtgaccgcaggctgctaaaaacagctccagcacccactccaaaccagggcctgaaacaatgtcctccaccgagagaaacgtaaaggacacttgatcacacaatccctggaataatatccaggaaacacttgctggagccactcgcagcacccttccctggcagcacacttggggacagcgaggagatgagcgcatctctgaattacaaatcttt

SEQ ID NO: 609 - DNA, 255 bp, Homo sapiens
gggacgtgcgcgcatgcgcgctaggactccgctccgcctacgctgcaggcggagagcaaccgccaagcttggtgggagtcaaggttttcacatcctttctatgagtttcgccatctatagcttttatcaacaattgtggtttaatcaattagaaatattaaccaggagaaaatgtcaaatctaaaaatgaaagaggcggccctcatctatcttgacagaagtggaggcctccaaaagtttatagatgattgcaag

SEQ ID NO: 610 - DNA, 255 bp, Homo sapiens
gcgccgcgctgcgcaccgccgccgaccatgagcgaggacagccgcggagacagccgcgccgagagcgccaaggacctggagaagcagcttcgcctgcgcgtgtgcgtgctcagcgagctccagaagaccgagcgggactatgtgggcacgctggagttcctggtgtcggcattcttacacagaatgaaccagtgtgcagcatcaaaagttgacaaaaatgtgacagaagaaacagtgaagatgttgttctcaaac

SEQ ID NO: 611 - DNA, 255 bp, Homo sapiens
gtgctcgtgcccgcgcgctcgcgcccggagtgtggacgggggcgcgcccgtgcgcgcgcaggggagaggccagcccaggcagccgttgtcgggttcgactggaggggcgggggagtcacctgcgagcggctgcgctggcggccagcccgcccaccgcgtctggatcgcgccggctgcgcggggctgcggacagcacacaccctggaaggccccggcggggaacgggcagagtccgcgccctgcgtccgcgaccag

SEQ ID NO: 612 - DNA, 255 bp, Homo sapiens
gcggagaggagggacgggctgggagagggcccggactaggggcggcgggcaccgcaggagctccgcgcggctgcagcgcgggcgggagcggggacgcgatgtcgccgccgccgcctccttgcgggccggggctgcgcctccggggctgagccgccgccagagccgacagccgagcagccgctgggcgctcccgcggcgcaggaggatgggctgcggcgggagccgggcggatgccatcgagccccgctactacga

SEQ ID NO: 613 - DNA, 967 bp, Homo sapiens
ccaactttgtacaaaaaagttggcatggcgaaggtctcagagctttacgatgtcacttgggaagaaatgagagataaaatgagaaaatggagagaagaaaactcaagaaatagtgagcaaattgtggaagttggagaagaattaattaatgaatatgcttctaagctgggagatgatatttggatcatatatgaacaggtgatgattgcagcactagactatggtcgggatgacttggcattgttttgtcttcaagagctgagaagacagttccctggcagtcacagagtcaagcgattaacaggcatgagatttgaagccatggaaagatatgatgatgctatacagctatatgataggattttacaagaagatccaactaacactgctgcaagaaagcgtaagattgccattcgaaaagcccaggggaaaaatgtggaggccattcgggagctgaatgagtatctggaacaatttgttggagaccaagaagcctggcatgaacttgcagaactttacatcaatgaacatgactatgcaaaagcagccttttgtttagaggaactaatgatgactaatccacacaaccacttatactgtcagcagtatgctgaagttaagtatacccaaggtggacttgaaaacctcgaactttcaagaaagtattttgcacaggcattgaaactgaacaacagaaatatgagagctttgtttggactttatatgtcggcaagtcatattgcttctaatccaaaagcaagtgcaaaaacgaaaaaggacaacatgaaatatgctagttgggcagctagtcaaataaacagagcttatcagtttgcaggtcgaagtaagaaggaaaccaaatattctcttaaggctgtcgaagacatgttggaaacattgcagatcacccagtcttacccaactttcttgtacaaagttggcattataagaaagcattgcttatcaa

SEQ ID NO: 614 - DNA, 255 bp, Homo sapiens
gaaatgcgtcatagcgcgcgtctgtttggatgtggaagccgagacctaaagttggggggtgatctctgaggagatggatcggtacctgctgctggtgatctggggggaaggaaaattcccgtcggcggccagtagggaggcagaacatgggccagaggtgtcgtcgggtgagggtactgagaatcagccggacttcacagcagcaaatgtttatcacctcttgaaaagaagcattagtgcttcaattaatccaga

SEQ ID NO: 615 - DNA, 255 bp, Homo sapiens
ttttggcgtagattccccactgatcgaggcattttttttccctttttttttcctttttttttttcttttaaaaattttggccatcgttctccgtacgggggctttttctgtctgtctgtctggctggcaggctggctttccccctctttcccacggagcccgagccgggcgcccggtggggagtggggagtgggtggggggagccagcagagttccattttggaacgcccgtgccgcgtctccgcgttcccagcc

SEQ ID NO: 616 - DNA, 255 bp, Homo sapiens
acagcagcaacggcagaggccagcgggcgaggtcaagatggtggctccgcgggcgggggaggcagtggagggaggaggagtcagaccttagccagccggaaacaccgaaacccagagacctcctggggagccgccgccgccgccctctcggccatcgctgcctccgccgcctgctccacctcgagggacgcgagcgggcggcggggctggccgtgagagagacaggagaggaaggagggcaggggcggagttgcc

SEQ ID NO: 617 - DNA, 255 bp, Homo sapiens
gcagtggtttctcctccttcctcccaggaagggccaggaaaatggccctggtcctggagatcttcaccctgctggcctccatctgctgggtgtcggccaatatcttcgagtaccaggtggatgcccagccccttcgtccctgtgagctgcagagggaaacggcctttctgaagcaagcagactacgtgccccagtgtgcagaggatggcagcttccagactgtccagtgccagaacgacggccgctcctgctggt

SEQ ID NO: 618 - DNA, 255 bp, Homo sapiens
ggcggcgcggctggtccccaggggtctgcgggcgactgcgcggctgaggcgcccgagtgcggtactggcggcgggcggcgggcagccatggcggaggccgcgtcgccgcacttgtcgctgccctcggggctgctggagctctgcgcgctgctgggcgccccccgggacagtctccgaagtctcgagcagaggtcctgtccattttcgtgcctccttttatcagtaaagaggacagtcaaacggccggtgccaact

SEQ ID NO: 619 - DNA, 255 bp, Homo sapiens
ggcagtgtagctgcgagaacctttgcacgcgcacaaactacggggacgatttctgattgatttttggcgctttcgatccaccctcctcccttctcatgggactttggggacaaagcgtcccgaccgcctcgagcgctcgagcagggcgctatccaggagccaggacagcgtcgggaaccagaccatggctcctggaccccaagatccttaagttcgtcgtcttcatcgtcgcggttctgctgccggtccgggttg

SEQ ID NO: 620 - DNA, 255 bp, Homo sapiens
ctcgggtcgcgggcgttggcagccgggcgggtgggaggggccggagcaaaagttccgggcgcccgagccggctgctcgtgccatggagcggagtcccgacgtgtcccccgggccttcccgctccttcaaggaggagttgctctgcgccgtctgctacgaccccttccgcgacgcagtcactctgcgctgcggccacaacttctgccgcgggtgcgtgagccgctgctgggaggtgcaggtgtcgcccacctgccc

SEQ ID NO: 621 - DNA, 255 bp, Homo sapiens
tcctcctgggtcttgcctagcggcgggcgcatgcttagtcaccgtgaggctgcgcttgcccggggcccgcgcccccctaccccggggaccgcccccgggccgcccgccccacttggcgcgccacttccgcgtgcatggccctgctgccccgagccctgagcgccggcgcgggaccgagctggcggcgggcggcgcgcgccttccgaggcttcctgctgcttctgcccgagcccgcggccctcacgcgcgccctct

SEQ ID NO: 622 - DNA, 255 bp, Homo sapiens
gggggctttgtgcgcggcggcggcgggagaggcggcggcggcggccagcacggaggcggaggccgagggggctgtgcacaggtcgccgcggagaggcgtgcgaattccgagccgagcgccgaggaccgtgctacccaggccgggctgccagccgcaggctcctctctggcagcagcggcggcgcggcgacccccgtccctcggcctccccttcccatcccacctcccgagccttcctcttcccgcagcacgcccg

SEQ ID NO: 623 - DNA, 255 bp, Homo sapiens
ggcggctccggagtccgggaggctctggctgctccagtcgcgggtccgggccccgcctctccactcggcggtggcgtccgtgttgttattgtggtggtagcggcgtctggctgctgcggaccccgccgagtcctagcgcctggcctgcgcgccgctgcccgcgccacagccccatcactgagaagaattttttcactgtatagttgcctctgcacttaaagcaggcttggtccatgaatcccatgacaagagctt

SEQ ID NO: 624 - DNA, 255 bp, Homo sapiens
ggcggccgcagcctcggctacagcttcggcggcgaaggtcagcgccgacggcagccggcacctgacggcgtgaccgacccgagccgatttctcttggatttggctacacacttatagatcttctgcactgtttacaggcacagttgctgatatgtgttcaagatgagtgggatgggagaaaatacctctgacccctccagggcagagacaagaaagcgcaaggaatgtcctgaccaacttggacccagccccaaa

SEQ ID NO: 625 - DNA, 255 bp, Homo sapiens
ggaggcggccgcggcaccagggagcgtcgtctccctggtgcgcatgctcgcccccgctgcgggctagctgttgtgtttttttttttcccccgggcggcccggcggctgcgtactggctgtgggatgggaagtgaagccccagcgagcggctgcagcggggccgtgaggagcagccagcgggaggcggcggcgagtcggtgagcagctgggaagagcagaaccggggcggagcacctgcaggcgcgggcggcggcc

SEQ ID NO: 626 - DNA, 255 bp, Homo sapiens
aaagattgatctctgggctggtgaacataatctctgtcccagtcagaaaaggagagaggaaattagcagagcgattggtggagaatgatatctgtcaaaagaaacacttggagagcactgagtttagtaataggtgactgccggaaaaaagggaactttgaatattgtcaagatcgtactgagaagcactccacaatgccagactcacctgtggatgtgaagacgcaatctaggctgactcctccaacaatgcca

SEQ ID NO: 627 - DNA, 255 bp, Homo sapiens
ggcgaccgaacgcggcggtcggcagcgttcgcgcgggggcctgcgaagcgctgctcggggccggcactgcccgcggggaggacgcgccgccgccgccacccagcgccgccgccgccgccgcctccagccgggccgccgcgcgtcccgggggccggccccgcgagcgcaggagtaaacaccgccggagtcttggagccgctgcagaagggaataaagagagatgcagggatttgtgaggttacggcgccccagctg

SEQ ID NO: 628 - DNA, 255 bp, Homo sapiens
caaatgggaaaaaaaaaaaaaaaaagggaagtagcaggtggagataatttaaatagcacagggacccctgcttaccaatccctccacagagttttgccctggagtaagcatgacatcagggtgcttgctgcttcctccagtggcccgagctctgtgtgcctttgttgaacaaggttttcgtggagctgaggtgactctcatgaacagagaatacctgtccttcatacagagaagcacccaaatgcaaacatctac

SEQ ID NO: 629 - DNA, 255 bp, Homo sapiens
aaaaaaattttcttccgccgtccgccggtggcgaggcccaggctgtcgccgggtgtgcagcggcgtcgcggccagtagagggattctgggtaacggcccggacccccggctgggcttctggctcggcgcagcaggttccattcacgccaagtctgttggcagtggcagttgtagggccaagggcggttgtaggacccggagcagccggacatggaacaaccgtggccgcctccgggaccctggagcctccctcgg

SEQ ID NO: 630 - DNA, 255 bp, Homo sapiens
ggcgcgaggcgctctcgctctcctcctcctccgccgtcgcccctccccccgcgcagcccccgccgccaccgccgcgagacccccgcacgccgctctccccccaccctctcctgccccgcgcgccctccggcccctgcggcccccgaagagaacgagagggcgagcgagcgcggcgttcccgggccggcccggccccctcccttcaccatcgccggccctccgccgccttcctccgcttccacctcctctcccccc

SEQ ID NO: 631 - DNA, 255 bp, Homo sapiens
agacgcccaaatgagtggggcggtgaggggaaggaggagggaagtaggacttcaacatggcggctgcggcactggcggtggctacggtgacggcctggcccggagcgggcagagttggaggtggtggcgttcgctctccctaggggctgtcgggagctcagcggggaccgagcctgggaggccggccggtgccagcacctttcggcttctgagacggcggcagcagcggcattcaggttctaaatggcttctaag

SEQ ID NO: 632 - DNA, 255 bp, Homo sapiens
aaaacggtaactgcaccgcggcagggactcgctggggcgcggagccgagccctccccttccttaggaagctttcgtcccctccgaagaccatcagcatatccgctacaacccgctgcaggatgagtgggtgctggtgtcagctcaccgcatgaagcggccctggcagggtcaagtggagccccagcttctgaagacagtgccccgccatgaccctctcaaccctctgtgtcctggggccatccgagccaacggag

SEQ ID NO: 633 - DNA, 255 bp, Homo sapiens
agagggcagggagatagtgtgagacaggagcccaggggagaaagacagaaactaagactcaaggagcaacgcaaagcaaagtcaaggagtcaagaccagagtagctgagcagaggccaagaagggtctgagagggctgtgcagcagcaatggccctaaggatgctctgggctggacaggccaaggggatcctaggaggctgggggatcatctgcttggtgatgtctctactcctccagcacccaggagtctacag

SEQ ID NO: 634 - DNA, 255 bp, Homo sapiens
ggcgaggcgaggtttgctggggtgaggcagcggcgcggccgggccgggccgggccacaggcggtggcggcgggaccatggaggcggcggtcgctgctccgcgtccccggctgctcctcctcgtgctggcggcggcggcggcggcggcggcggcgctgctcccgggggcgacggcgttacagtgtttctgccacctctgtacaaaagacaattttacttgtgtgacagatgggctctgctttgtctctgtcacaga

SEQ ID NO: 635 - DNA, 255 bp, Homo sapiens
acgcgctgtgcgccggaagagcacgcccagtccgggctgcgcggaggaagcgctggggtcccggagggcgggggtggcggcgccggaggtcgccatggctaccgagcccgaagccgcggagccggtggtgccttcgctcgtggatcgatacttcactcgctggtacaaaccggatgtcaaaggaaaattttgtgaggaccactgtatactacagcactctaaccgaatatgtgtcatcacattggcagaatctca

SEQ ID NO: 636 - DNA, 255 bp, Homo sapiens
caggctgttctccaactcctaagcccaggcaatctgcctgtctcggcctcccaaggtgccgggattgcaggtgtgaaccgccacacacaaccccaatttttgtttaaaatttgcatccacattaacaaaacttttattagaaaaattcatttaatatctaggcaaaattatatcactttcaaaactttttaagtaaattcagtaacatatcaattcagtttattagcatcaaatttgatgaagcagtgcataaat

SEQ ID NO: 637 - DNA, 255 bp, Homo sapiens
gtgacaacgggggcgaagcgcaggcgcaaggagcaagcgcagattgtgggcggctgtgtcagctgacccaaggggccttcgaggtgccttaggccgcttgccttgctctcagaatcgctgccgccatggctagtcagtctcaggggattcagcagctgctgcaggccgagaagcgggcagccgagaaggtgtccgaggcccgcaaaagaaagaaccggaggctgaagcaggccaaagaagaagctcaggctgaaa

SEQ ID NO: 638 - DNA, 255 bp, Homo sapiens
tagcttcctcttgctgtttctttagccactggtctgcaggcgttttcttcttctaacttcctctcctgtgacaaaagagataactattagagaaacaaaagtccagaatgctaaggttgccgctttcacttcctctcaccctttagcccagaactgctttgaatacaccaattgctgtggggcggctcgaggaagagaagacaccagtgcctcagaaactgctcggtcagacggtgatagcgagccacgcattca

SEQ ID NO: 639 - DNA, 255 bp, Homo sapiens
gtgcccctgcagagcgaggcagagagcaactaaaagaaatttctcctgattggagggtgggtgggatgaggctgggggagggggccggggtgtgtgtcccactgtcatgtaaatatcccttccaggcagggcggctccagtgcagatttaagccgctggcacctggggcagtctcagtgttcagcctgcttccggacgggcgaggagactcgtggtctggttctgggacttccctaacagcatggcccctaaacg

SEQ ID NO: 640 - DNA, 255 bp, Homo sapiens
gggcgacttccgcgtggggtgagaggtcgcctgcgagggtgaccgggcaggagggctcagtgcgcaagccggacgtgctgggtccaagattattgattaatttgggcaccgcgagggctcgagtccccccacaccactgcccggcctgcgggggagcacagacagcccgggccctcccggctgcaggtcccgggctttccccgcgcggttgccggctccgcccagaggagccgcgcccggcggaggggtaagaaa

SEQ ID NO: 641 - DNA, 255 bp, Homo sapiens
actccagcttcgagtgtgagagacccgtcccggtgggagggacctgggctgggggggacggtaggggaacaagggcgtgggactggggaagcttctgggaacatttgctctaggtattcagctaaactaagaaaaattggtccaaggctcggcacaaaaggatcttctcattccagtcctttcgcccacgcagggaacgatgcctctggaggtggtggtggagctgcagatccgggcgatttcttgcccaggagt

SEQ ID NO: 642 - DNA, 255 bp, Homo sapiens
cctcggacgcctggcggcgccggcgcacactgctcttccttaagggcgggagtctcggtttgtggtggcttcgctgaggcagtggtggccgcactataccgttagaaactcaatttcccggaggttgtgaggccctttgaggcgaaatcgctctgggcgtgaaaggagcaggcgttggcaatggaaggaccaccgcgacctcaggctgaccgtagggagggatcttgagggccctccgagtcccctgggcttgcg

SEQ ID NO: 643 - DNA, 255 bp, Homo sapiens
agccgctaaggccgctcccaccccgtggtatcctgggactaggcttttccggaaggagcggctcggtgttggggctaggccggtattctaggcccaagcccaggcccaggcctgtgttcccggcccttgctcaaagacaggccggtggccgctgcgacactctaggtacagcggagggcgcagcgggccgttcgctgaggtgtccggacccgccgccgagcgggccgtggagccacagtacgtggcggcgcctct

SEQ ID NO: 644 - DNA, 255 bp, Homo sapiens
ggaagtgacgcataacctgcgacgccagtgcctgccgcccacggccgcaggagtcgggcttcggtcgcaccagagacagcggactttcctccgatggttgcagcagagggatcatgacggggaaaaagtcctcccgggagaaacggcgcaaacgtagcagtcaggaggcggccgcagcgctcgcggccccggacatcgtacccgcgttggccagcggcagcagtggaagcactagcggctgcgggagcgccgggg

SEQ ID NO: 645 - DNA, 255 bp, Homo sapiens
gtaataaccgcgcgcggcgctcggcgttcccgcaaggtcgctttgcagagcgggagcgcgcttaagtaactagtccgtagttcgagggtgcgccgtgtccttttgcgttggtaccagcggcgacatgacggggtacactccggatgagaaactgcggctgcagcagctgcgagagctgagaaggcgatggctgaaggaccaggagctgagccctcgggagccggtgctgcccccacagaagatggggcctatgga

SEQ ID NO: 646 - DNA, 255 bp, Homo sapiens
cagagactttgccaccaccagtattggggatgctgagctgcggggtacgggcctgaggagggatgggagtaagaagtgctgtggaaaccgtcaggccatgaaccaggctgaccctcggctcagagcagtgtgcttgtggactctcacatctgcagccatgagcagaggcgacaactgcacggatctactcgcactgggaatcccctccataacccaggcctggggactgtgggtcctcttaggggctgtgacgct

SEQ ID NO: 647 - DNA, 255 bp, Homo sapiens
agtaggctggagccggggtcagctttggcaccttcctccagtcagtggccaactcctggctcagtggggattgtgctcgtcccctccgttcccctccagtcttcctcccgctaccggaacgagcctcgcgcttggcaggctgaggaggagcaaagaaagcaggattaaagagaaggaagacctggctaggtctgggtggcgtctgcagtgccagaaagggaggcggtggcggcggcggctgcgaccacggccgcg

SEQ ID NO: 648 - DNA, 255 bp, Homo sapiens
actacaaaggatgtctgtgatgacagtggccatcccatttgatcctcgttattcttcttttatcgaaggaaactgagagtcaccttcttttctaggcagttaggtaactgaagccgaaaggtattgtgacagatccactgggctgtaaaaggcagcgtgtggaggtggagcccagagtttctgcctccacagttaaaagctcagacagggctttgggagcagggcctgcaaatcaaagatgaaagaacaacctgt

SEQ ID NO: 649 - DNA, 255 bp, Homo sapiens
ggaggcgagcgaacagagggagggacccgcccgccgcgccccggccgctgggcatgtgtgtccgcaggcgcccgacgctgccgatgtcccggggctgagccgcgcccaggtgtcccggacagtgcgtgcgagcgtgtgtgtccgcgcaggcgagcaccgcgccggccctgagcctcccgctcgctccccacggccgcggtgcatgttcgcctcctgccactgtgtgccgagaggcaggaggaccatgaaaatgat

SEQ ID NO: 650 - DNA, 255 bp, Homo sapiens
gagattattgcagaagtttccaaactgaagcaagctgtgcccaggtccctgtaacagcaggtggctttctgacatcagcagagactggtgctttttcccaggtacaaaggacctccagaccagagccagccagcagcaaaaagagcatggagctgaggagtacagcagcccccagagctgagggctacagcaacgtgggcttccagaatgaagaaaactttcttgagaacgagaacacatcaggaaacaactcaa

SEQ ID NO: 651 - DNA, 255 bp, Homo sapiens
tgaggagggcccggcctgcgagagcctcagtgggagccggctcagccctcggccaccatgtcggcgccgtcggaggaggaggagtacgcgcggctggtgatggaggcgcagccggagtggctgcgcgccgaggtgaagcggctgtcccacgagctggccgagaccacgcgtgagaagatccaggcggccgagtacgggctggcggtgctcgaggagaagcaccagctcaagctgcagttcgaggagctcgaggtg

SEQ ID NO: 652 - DNA, 255 bp, Homo sapiens
agacagctagccaagattctaaagaaacccagacaaggcagggtggagaccgagaggagaaatttattccagaaattaactgttagcagtagtgtttcttaatacataagctatatcatactcctcaagtagattctttgcttaaaactttcactgtaaataattttatagcaaccatgtgaataacttaagaataatagaatcagtctcatttgtaggcactgtagaccatctccattccctacatgtcagaga

SEQ ID NO: 653 - DNA, 255 bp, Homo sapiens
gcaactgaagacggaggtgcccaaggtcagaaggaagcaccacacagagggcacaggcaggatggccgatgctgacaggaaccagcggtgactctggggcccctggcagcagctctgtctcctgaagatgaagtggcccaggtgaagcccaggccagccccaatggccagctcggagactgagatccgctgggctgagcctggcctggggaagggcccccagcggcggcgctgggcctgggccgaggacaagagg

SEQ ID NO: 654 - DNA, 255 bp, Homo sapiens
ggggccggccgcctgtcagagggaggtggcgatggtgcgcccggtggcggtggcggcggcggttgcggaggcttccttggtcggattgcaacgaggagaagatgactgaccaaccgactggctgaatgaatgaatggcggagccgagcgcgccatgaggagcctgccgagcctgggcggcctcgccctgttgtgctgcgccgccgccgccgccgccgccgccgtcgcctcagccgcctcggcggggaatgtcacc

SEQ ID NO: 655 - DNA, 255 bp, Homo sapiens
tatatccgtggtttcctgctacctccaaccatgggccttttgggaatactttgttttttaatcttcctggggaaaacctggggacaggagcaaacatatgtcatttcagcaccaaaaatattccgtgttggagcatctgaaaatattgtgattcaagtttatggatacactgaagcatttgatgcaacaatctctattaaaagttatcctgataaaaaatttagttactcctcaggccatgttcatttatcctca

SEQ ID NO: 656 - DNA, 255 bp, Homo sapiens
cttccggcgcgctgggagacgtgcggttccgggtcgctgctcggctcgccggctgggcggtgggggttggtgacgcgggccggggctcacgagaggcccgggaggcggggctttgctggcttcccagagagaggcaggacagaatgctttgacctccaagctgttttaaatctagtagataagccagatcctgtgttgccataagcccttggcccacatttaagtgggaatgcagctagcttggatgtctgaaac

SEQ ID NO: 657 - DNA, 255 bp, Homo sapiens
gagtttcactggtttaaaaatacacagaggaagcgagtaagagaaaggggaaggggaggtgggagaggcacctcaactttgatgtcccgagccttgagtggccactcgcaagctggccaagggcttcacacaatttgccaagatgacagaggggaccaagaagaccagcaaaaagttcaagttcttcaagttcaagggctttgggagtctctccaacctccctcggtccttcactctgagacgatcctcagcttc

SEQ ID NO: 658 - DNA, 255 bp, Homo sapiens
agtctcaccggtccgcccggccgcgcggcgtgagctccccggacatcgcgtctcgggatgctgcaagccagcgcggccgctcgcgcgcagccccgcacctccgcccctgcctctgcctcctgggccatgccctgctgtttacatgccggtgaggtccccggccgctccgaacccctccgagccccggctccccgagggtgaagcccgccggcccgcgaactggactggtggatctctcagacctggggccccgga

SEQ ID NO: 659 - DNA, 1786 bp, Homo sapiens
tttttttttttttttttttcggagatggggttttgctatgttgcccaggctggtcttgaactcccgggctcaagcagtcctccagtcccagtctcttgagtagctgagattacaggtacgcaccaccatgcccagcttgtgtggggtttcccttgaagatcagtctcaaggttgctgcttgaccggtgagcagcaggattcagacctagatgtgtctgactctgggatcctttcacctaaccctgacgctttcccagcaagcctggatgacctggcttccctccaccctgtgcccatgccctgccccttttccatcttggagtttctgaagccccagtgggctgtccactctgtgcttctttgggtcacttatgatgccagcctccctcccggcccacccgccaatcccaggccactgctaataggggtgtctttggcaggggaacaaagagcgttttggggctgccaggtggctgctctgagtgctccagtgttggccagagtggcttggcttccagaaacttcttgctgcctccttgcaggaggaggtcctggccatgctaggactgtgagctgctccccctgaacccctggcaggagccagacgctgctgtgctgccacgctggctcttcagcccctggacggacgccttggctggtccccagggcaggctcctcccaggcggctgtattctcttctcttcggggaagcacaaggcagatgttgtcgatttaaattgtttccttattagactctcgctctctggcctgggctgggtttcatcagccgggaactctgattgcatcactttgccgctcactcctccaggaaccaggccaagggctgggagagcaggcagggtgggagtgagcgtggctgagggaggggcagacggatggcaggcaagggacttaagtgatggacttaagtgatggggccctgttctgggggaccagcactgtcaggaacccaggagcacagctggaacctggagttccacacgcctgtcagagcgctactgtctcttagctgggtgcccagctccctgcatcagaatcacctgagagctcgtttaaaatgcccttttaagacctgcagcagtgactctcaaccagggttgatttggcgatctctggagacattttcggttgtcacacctggggctgtgctactggcagggtgctgctgaacatcccacagtgcgcaggacagcccctcacaaaaagaaaccctgtcctgcggagtctgtggttctggaagggctcactgggaatcttcgtttgtcatgagccagtggaatgttttttggtttttggtttttttttttttttttttttttgagacagtcttgctctgtcacccaggctggagtgcgatggcgcgatcttggctcactgcaacctccgcctcccgggttcaagagattctcctgcctcagcctcacaagtagctgggattacaggtgcccgccaccacatctggctaatttttgtatttttagtagaggtggggtttcatgtttcaccgtgttgtccaggctggtcccgaactcctgacctcaggtgatccacccgcctcagcctcccagctacttaggaggctgaggcaggaggatcatttgagcccaggaaacatagtgagaccccttacctccaccatgcccagcttgtgtggggtttcccttgaagatcagtctcaaggttgctgcttgaccggtgagcagcaggattcagacctagatgtgtctgactctgggatcctttcacctaaccctgacgctttccc

SEQ ID NO: 660 - DNA, 255 bp, Homo sapiens
gtcacttccggcgggggcgcggcttggactgaggagcggacccggccgggcgcaggggctggactggcggagcaggtggggtccgcggccgccggagcgttccggtcggcgtctgggcatctcggcctcggcagaaagcgcgaccgccctgctgcgcggggcccgcggcgatgccgttcctgcacggcttccggaggatcatcttcgagtaccagccgctggtggatgcgattctgggctccctggggatccagg

SEQ ID NO: 661 - DNA, 255 bp, Homo sapiens
tttttaaactttttttatttaaataaggagaattctttcatatggaaagagctagtacaatcacatatttgaaaggagaaacaataggtactgaaccggagggaaagggcgagggtgagtgtgccagcaccggcctggtgaatccacgattcgatttcccatccaaggtaagtttcccaaaataccgtataaacaagctgcacattacacctctagccatcgtctgccctttcaaatatctggtctacatggaaa

SEQ ID NO: 662 - DNA, 255 bp, Homo sapiens
gaggggacgtagcgtcgccgcgccaggtctctagcagctgccgctgagccgccggacggacgctcgtcttcgcccgccatggccgagagcgactgggacacggtgacggtgctgcgcaagaagggccctacggccgcccaggccaaatccaagcaggctatcttagcggcacagagacgaggagaagatgtggagacttccaagaaatgggctgctggccagaacaaacaacattctattaccaagaacacggcc

SEQ ID NO: 663 - DNA, 255 bp, Homo sapiens
cgcgcgctctgccttcctcggccatcgatgcctcggggctcgtggcgtcgggcctggcgggctccccgttgggcgggggcggcggtccgagcggctgcggcagcggaagcgggtccgggtcgcgcagggcgggggcggcgcagcgggcggaggcggccgtgggccgcctgggcagaatgtcacgatggacgagggcggcacgcccctgctccccgacagcctggtctaccagatcttcctgagcctgggcccggc

SEQ ID NO: 664 - DNA, 255 bp, Homo sapiens
gcttccggttgctagcgccggtcagagagaaagtcggcatgttctcgcaggctgccgggcgtcccggggttgcctcttgcccgtgaccctgacgggagacagagcgcgggcggccgcggcgtccctgtcagcgcccgcggcgaggaccccggggctggggcggacggcgtgcccctgaggggggtccccgcgggagcgcggagccggcgactggtgcttcccacgtgcgccggtgtcgcgagggcccgggaggac

SEQ ID NO: 665 - DNA, 255 bp, Homo sapiens
ctgctttcaaggtgtctagatacagagtgaagaatgtcacagtaggaagtgcactggactaggggagtcaggagacccgggttcttgtgttggcaccatcactcatgagctacgaggtgacttcaggctgccattggacctgtcaagtgcctgagtcatgtgataatgggctacattgcgcagggcccctgggccatctccacaggagatgccagaggacgagtgcccacttgctggtcttcacagagcacgctg

SEQ ID NO: 666 - DNA, 255 bp, Homo sapiens
ggcgccgtcttgatactttcagaaagaatgcattccctgtaaaaaaaaaaaaaaaatactgagagagggagagagagagagaagaagagagagagacggagggagagcgagacagagcgagcaacgcaatctgaccgagcaggtcgtacgccgccgcctcctcctcctctctgctcttcgctacccaggtgacccgaggagggactccgcctccgagcggctgaggaccccggtgcagaggagcctggctcgcag

SEQ ID NO: 667 - DNA, 255 bp, Homo sapiens
aaaagggcggtggggcggggggcggggcagggagagggagagaaatccagcagacatctagctctgcctttctttcccagccacagccagggtagggctgataaggcgctgatgcgttgatggcagccttgcagagctagacctgcacttaacttgcagctgcctcccgagcctccaagatgtccacgccctgggtgacaggcggcagggcgctgccccgtgctcccccggctctgctcgacagcagcacgcagt

SEQ ID NO: 668 - DNA, 255 bp, Homo sapiens
gcctctccaaaggctgcagaagtttcttgctaacaaaaagtccgcacattcgagcaaagacaggctttagcgagttattaaaaacttaggggcgctcttgtcccccacagggcccgaccgcacacagcaaggcgatggcccagctgtaagttggtagcactgagaactagcagcgcgcgcggagcccgctgagacttgaatcaatctggtctaacggtttcccctaaaccgctaggagccctcaatcggcgggac

SEQ ID NO: 669 - DNA, 255 bp, Homo sapiens
agctccgcgcgggggcttcctcggctccttgctgttgccgccgccgcagctgctgccgcggttggtggggttgggtgagaggaggagctgtcgcggaccctgtagagtcggtctctgttgctctttttgcctgaggagtcttccatcctacgtcgagctctgactcccgtgctgtcgagagggagtccccggggacacctcggcacgcagcggagatgcctctttttgccaccaatcccttcgatcaggatgttg

SEQ ID NO: 670 - DNA, 255 bp, Homo sapiens
ggtggcgcgcggcgtccggtgaggggcagcggcccgggctcggttccggcttccagcagcggcccgaaggcgccggagcacgctccccgctccccagaacgcagcttccgcggctgcagcccaggcagctcttcgggaagcgtccgcccgtggtctcgccagggggtttccgacctccccgcccgacagcgcaggggcgggggccgcggccggagagctcgcccgagagcaccccctcccgctgcgcctctgggc

SEQ ID NO: 671 - DNA, 255 bp, Homo sapiens
tttacggcgcggagccggagagacctgggctggcgcgggcgggagctgcggcggatacccttgcgtgctgtggagaccctactctcttcgctgagaacggccgctagcggggactgaaggccgggagcccactcccgacccggggctagcgtgcgtccctagagtcgagcggggcaagggagccagtggccgccgacgggggaccgggaaacttttctgggctcctgggcgcgccctgtagccgcgctccatgct

SEQ ID NO: 672 - DNA, 255 bp, Homo sapiens
tataaaataacagtagataccaatgacttagaagaaaaaaaagccttgacatctctatttcctcatctctaaaggtgataacacttgcactatggtgatcctactagtaatacatttggagccacgttgtaaacttcagagtttgcaccattattattatttttttattattattattttttgagatggagtttcgctcttgttgcccaggctggagtgcaatggcgcgatcttggctcactgcaacctccatct

SEQ ID NO: 673 - DNA, 255 bp, Homo sapiens
ccggggccagggaccagtggtgggaggaggctgcggcgctagatgcggacacctggaccgccgcgccgaggctcccggcgctcgctgctcccgcggcccgcgccatgccctcctacacggtcaccgtggccactggcagccagtggttcgccggcactgacgactacatctacctcagcctcgtgggctcggcgggctgcagcgagaagcacctgctggacaagcccttctacaacgacttcgagcgtggcgcgg

SEQ ID NO: 674 - DNA, 255 bp, Homo sapiens
attcctctgtcctcactcccctgtcaacttctaaaacagagtagcaagagcagcaggctgtggcaggccaactccacatgctcatggctctggagggctcagcacaggtccttttcaaggagataccccggctctgacaggatcatgctgcagaagtggcagaaaagggacatcagcaattttgagtatctcatgtacctcaacaccgcggctgggagaacctgcaatgactacatgcagtacccagtgttcccc

SEQ ID NO: 675 - DNA, 255 bp, Homo sapiens
attttctaaaagggacagagagcaccctgctacatttcctaatcaagaagttggcgtgcagctgggagagctagactaagttggtcatgatgcagaagctactcaaatgcagtcggcttgtcctggctcttgccctcatcctggttctggaatcctcagttcaaggttatcctacgcggagagccaggtaccaatgggtgcgctgcaatccagacagtaattctgcaaactgccttgaagaaaaaggaccaatgt

SEQ ID NO: 676 - DNA, 255 bp, Homo sapiens
ggcgccgtttccagttgagagatggcggccgccgcaggtagatcgctcctgctgctcctctcctctcggggcggcggcggcgggggcgccggcggctgcggggcgctgactgccggctgcttccctgggctgggcgtcagccgccaccggcagcagcagcaccaccggacggtacaccagaggatcgcttcctggcagaatttgggagctgtttattgcagcactgttgtgccctctgatgatgttacagtggtt

SEQ ID NO: 677 - DNA, 255 bp, Homo sapiens
acttccgcccccgcggcaaagcagggaggtcggaggactggagaggtggggaccctggggaggtggctgctcggagtctaggtgacggggcgagacggggccggtaggtggcgggaggggccgggccggagccggcgggagggccaggcccggaggcccccaccctggcgtgcctgccccggccgcggctgaggaggaggaggaggaggaggaggaggaggatgatctccagatacactcggaaggcggtgccac

SEQ ID NO: 678 - DNA, 255 bp, Homo sapiens
gatgtaagagtcatctgtaaaagctgtgctgttttggcagcctgggaggctaaggtttagtctaggcgactaaggtttagtccgggctgtattcacacccaaaacaactaaaaaagcggaggagtctttgagtcaatccctgaagctccggctaagaggaaactcgcccacgctccagggcagcgacgccggctccacctcagccacggctgtctcaagcttctcggggttttccgccggctccacccgagccac

SEQ ID NO: 679 - DNA, 255 bp, Homo sapiens
cctcccctcgcccggcgcggtcccgtccgcctctcgctcgcctcccgcctcccctcggtcttccgaggcgcccgggctcccggcgcggcggcggagggggcgggcaggccggcgggcggtgatgtggcgggactctttatgcgctgcggcaggatacgcgctcggcgctgggacgcgactgcgctcagttctctcctctcggaagctgcagccatgatggaagtttgagagttgagccgctgtgaggcgaggccg

SEQ ID NO: 680 - DNA, 255 bp, Homo sapiens
agggaagaagggagaaagagagagagatttgaatatacattgcttcaaggatgcaaaaaattacaacctggaaaaggcttcgagtaactttaggaaaatgagctgctggactcctcagtcaatctgtcctttctagtcaatgaaaaagacagggtttgaggttccttccgaaacggggccggctaatttagcccctcccacgagcccaagggtctgttatatctctgtttccttgaggacctctctcacggagac

SEQ ID NO: 681 - DNA, 255 bp, Homo sapiens
ggatgaaaggtcatcctttacggagaacatcagaatggtagataattcctgttccactttctttgatgaaacaagtaaagaagaaacaacacaatcatattaatagaagagtcttcgttccagacgcagtccaggaatcatgctggagaagttctgcaactctactttttggaattcctcattcctggacagtccggaggcagacctgccactttgttttgagcaaactgttctggtgtggattcccttgggctt

SEQ ID NO: 682 - DNA, 255 bp, Homo sapiens
gcgggagcctcccggcctgggattggtcgaaaaggaggggcgtggggcgggcgtgggggcagttccccagcccaggtcctcctctcacccgggccagttttcaaggcgggctgtaactggtggcatttgtcccgggaccaggtccacagttttatgtgtgagcaagatggaggctgacctgtctggctttaacatcgatgccccccgttgggaccagcgcaccttcctggggagagtgaagcacttcctaaacat

SEQ ID NO: 683 - DNA, 255 bp, Homo sapiens
gagtgggggaggggcgggcggggggcggcggttgggcagcgtcgcttcttaggaggaggaggaagaggaggaaggagggcgagcgaggaggatggcggagtcggggctcctgacggaactctaatgaatcattgattgaccagcactattttaccagttggaatgaatgatcagaaatgggcatagtgcttttagatccaacatgtaacagatggatgttactccatgctgattacttcttcaagccagtacttt

SEQ ID NO: 684 - DNA, 255 bp, Homo sapiens
agtcctaggagctgtggaaagagtagaagtgcctgaatgtggtgctgaatcaatacagccagctgtgaggggagcacttcctggacccaggaagggagagtcttcttccaaggtctgaatttcctgctgctgttcacaaagatgctttttatctttaactttttgttttccccacttccgaccccggcgttgatctgcatcctgacatttggagctgccatcttcttgtggctgatcaccagacctcaacccgtc

SEQ ID NO: 685 - DNA, 255 bp, Homo sapiens
gcaggcgcagtgtgagcggcaacatggcgtccaggtctaagcggcgtgccgtggaaagtggggttccgcagccgccggatcccccagtccagcgcgacgaggaagaggaaaaagaagtcgaaaatgaggatgaagacgatgatgacagtgacaaggaaaaggatgaagaggacgaggtcattgacgaggaagtgaatattgaatttgaagcttattccctatcagataatgattatgacggaattaagaaattac

SEQ ID NO: 686 - DNA, 255 bp, Homo sapiens
aagtggcaccagcacttccggtacggaaaactcgctgctgccccaacctggcttgacaggcttggtctctgcaagtggctctcagccccttcttctttcctgcctcaccttccaattcgtttgccgccgccgtcccgcagctgctgtttccggagttgccccttccccatgttccggggcaggagtccgcaaagcgaagatccgcccgccggttcctcatcatgtccgaactgactaaagagctgatggagctgg

SEQ ID NO: 687 - DNA, 255 bp, Homo sapiens
atgctcagttggttggagtggcctcactcttacctgccaacctgggaggttgatgatgaacatgtctttaccttttctttggagtttgcttaccttattaatatttgctgaagtaaatggcgaagctggagaacttgagctgcagagacaaaaaagaagcatcaatctccaacagcctcgaatggctacagagagaggaaatttggtgtttcttacggggtctgctcaaaacattgagtttagaaccggatccct

SEQ ID NO: 688 - DNA, 255 bp, Homo sapiens
cactgctctgactgcgtcctccccaggctgaagtgtcctcaggtttcatgtggatttgcccagtaatggatggctccaccgaggccaggttggggaagttcagcctcgaggacactaggggacgaaaaacttcaaaaagaagactctttttattaatattttggcgttctttttggagaggaacttttgggatgtagcctttacctgtttcctgaatttgacatccaaaaagccttttggaaaacaccattctaa

SEQ ID NO: 689 - DNA, 255 bp, Homo sapiens
aaaattggtaggagacatgtggaagaaagcaagtctcccgggtatttcagcacttcggcagaaacactggggcattctcattgccagcctcggggggtggctggcacaaagagcccaagattaaacgcggcgcctgggctggcgaggtcggggtcgtgtggtaactctccaggtgctcctcgctggatcccggggtcccagccccgccgccgcgccccgcccagctctgtccccgcagcctcgcgggctgccggg

SEQ ID NO: 690 - DNA, 255 bp, Homo sapiens
agctggttcccgtggggcctcatgggatggttgtcgtatccttctgaggtcctttaaggaccgtctcggacctgggaacccccggaggaaaggtcaccccggtcttctcccacgccctacctcagtgccgcccccaagcgccccgcagcccttagtatctagaggattaacctccaagggcgtcccgggcctcgccttggcgtccggcccggcctgggcccttagggtctgcttagctcttccccaagactcgtg

SEQ ID NO: 691 - DNA, 255 bp, Homo sapiens
attgggctgggctctctggaaggtgtgctgctgcctgagctgctggaaaagcactgacaggtgtttgctagaaaagcactcctggagcttgccaccagcttggacttctagggactttcctctcagccaggaaggattttgatattcatcagaaatacctccagaagattcaaggagctgtagaggtgaagtaagcctgtgaaggaccagcatgggaatcctatactctgagcccatctgccaagcagcctatca

SEQ ID NO: 692 - DNA, 255 bp, Homo sapiens
gactctggccgcggcgattcaatatatccggaagcaactgtcatggctgctgtcagtgagggcccgtaatggagatcgagtcaagggttgcccagggacacttaagagccttcggcttcaaggaggcctctcaaaggacaaaggatgagactgcctggcggcagagtgccccccacaatcgtaggaactgtgtcgccgcgcttcccgttaacttgccgctaagtttttctagaaaagtcgcccttcttgccaggg

SEQ ID NO: 693 - DNA, 255 bp, Homo sapiens
cacaaggtcgcagggccgttatgaggggaccccgggactcgaaccttggctccacagctgagccattctcgctacctgcccctcgtcacgccctccgtttccacacctttaacgcctcaaagatagaaggtgccgcccaaggggctggaaggagctgaggaaacgactccagaagaaatcaccactgactacgactcccgccggcccgccccggggagccttcggccgaccgtcccctcccccgccaccttccgc

SEQ ID NO: 694 - DNA, 255 bp, Homo sapiens
agtgctgggcgagtgggcggggccggctgttggcggcggttggctcggcgcgggagtcggctgcacgtgcgggcgggggcgatgcgtcactgatcggaggaacgagaatgaatatgactcaagcccgggttctggtggctgcagtggtggggttggtggctgtcctgctctacgcctccatccacaagattgaggagggccatctggctgtgtactacaggggaggagctttactaactagccccagtggaccag

SEQ ID NO: 695 - DNA, 255 bp, Homo sapiens
gctccctcgccgccctgaaccggcggctagactgcgcatgcgtgtcagtggcgctagcggcggacccggctgggcagttccttccccagaaggagagattcctctgccatggagtcctacgatgtgatcgccaaccagcctgtcgtgatcgacaacggatccggtgtgattaaagctggttttgctggtgatcagatccccaaatactgctttccaaactatgtgggccgacccaagcacgttcgtgtcatggca

SEQ ID NO: 696 - DNA, 255 bp, Homo sapiens
gagacagtaaggagccaggggaacagagagaattgtggggcagcaccgctccttgggtccccactccccatttctcattgcttggaaatccatgccaagatgcctgccttccttggtctaaagtgtctggggaaattgtgcagctctgagaaaagcaaagtcacctcatctgagagaaccagtgccaggggctcgaacagaaagagactgattgttgaggaccggagggtctctgggacctccttcaccgctcat

SEQ ID NO: 697 - DNA, 255 bp, Homo sapiens
gggcgggcgggaggcgcggaggcagcggaggctgctcggccgcaaggaggcaggcgggaggccaggggtgcagaattggggcgggggctcccttcacccccgcagccctccgcccgggtccgtgtggccaggcctcacgtgccccgcaggcctggggaaggtggagacaggggcgggggtccgcgcagaggcctgcacggcgcggccaggtgatggtgggcctctgtgtttctccagacgaaaggggacccccgg

SEQ ID NO: 698 - DNA, 255 bp, Homo sapiens
agaaggcgcgatgttgacggggtcctaagatggctgctgggcgaccacttcctgacagaagaaaagatgtggagtgggctgctacctcctggcctaaatgaaagtgacgctgagtcaaactcggaagatgaagctacgttggagaactctggacttaacttacaggaagataaagaggatgagagcatcagaaaaacagaaatcatagatttctcaacagatgaaccaaaaactgaaacagagtcaaatgtaaat

SEQ ID NO: 699 - DNA, 255 bp, Homo sapiens
agagggcccgctcaccaccccgtaggccccgcccctgcgtctctgcccgccccgtggcgcccgagtgcactgaagatggcggctgctgtaggacggttgctccgagcgtcggttgcccgacatgtgagtgccattccttggggcatttctgccactgcagccctcaggcctgctgcatgtggaagaacgagcttgacaaatttattgtgttctggttccagtcaagcaaaattattcagcaccagttcctcatgc

SEQ ID NO: 700 - DNA, 255 bp, Homo sapiens
aggtcgcaggcagcgcggtcggcggcggctatttcccgccattgtgcgaagtgaaggctaggggcccgtacgcgcccgcctgactgtcgccagcagctcctcggcggccccaccgcagccgccgctccctgaggcgcgggaggcccgcgccccgcggctcgctgtgcgtgggagggcgcgagcgaacgcgggcgaggagcggccgagccgctgaagaggagctgggcgccggccgcccggccgcgctcggcccgc

SEQ ID NO: 701 - DNA, 255 bp, Homo sapiens
gcaggggtttcagtttctggcgcgaacttccgccgttccgaagttgcacggtgaattggcgctatgtctggggacagcagcggccgcgggccagagggccggggccggggccgcgacccgcatcgggatcgcacccgctcccgctcccgctcgcggtcccctttgtcgcccaggtcccgccgcggctctgcgcgggagcgcagagaggccccagagcgcccgagcctggaggacacagagccgtcggattccggg

SEQ ID NO: 702 - DNA, 255 bp, Homo sapiens
cgcgcccgtcccgtcgccgccgccgccgccgcagacccctcggtcttgctatgtcgagctcacccgtgaagcgtcagaggatggagtccgcgctggaccagctcaagcagttcaccaccgtggtggccgacacgggcgacttccacgccatcgacgagtacaagccccaggatgctaccaccaacccgtccctgatcctggccgcagcacagatgcccgcttaccaggagctggtggaggaggcgattgcctatg

SEQ ID NO: 703 - DNA, 255 bp, Homo sapiens
ttcctatacttggtaaggggcctgcacgggcatagccccccccagcaagactccgcacacaccccggccacccagtcactggccaatgggctcctaggaagatcaaatgtcactataacacgagggtgtgagccgggcgccagtgcctgcagccggtgctgtccacagggagctccagcccttctcacactcgacccgcagaaaccacccaccttcaccatgtctgacgaggaagttgaacaggtggaggagcag

SEQ ID NO: 704 - DNA, 255 bp, Homo sapiens
gagaggttacttccggggcggcaccgagaagctgaaacggaagtggcgtacggcatgcgccggtggcgtgatggagcggcagcagcagcagcaacagcaactgcgaaacctgcgtgacttcctgttggtctacaatcggatgacagaactctgcttccagcgctgtgtgcccagcttgcaccaccgagctctggacgctgaggaggaggcctgtctgcacagctgtgctgggaagctgatccattccaaccaccg

SEQ ID NO: 705 - DNA, 255 bp, Homo sapiens
gctcgcgcgcccaacggaccaggctggggccgtgaggtaactgttgcagccagcggaggtgggaggcgacactgagtctccagtcccgagaggtgcccgagggaaaaggaggcggcagctaaactggtcctggagagaagccccttccgcccctctcctcagccagcatgtcccggactccgccgctcctcagtccgcgcggtggggaccccgggccgtggcggccggcgcagccctgacgggttgcgaaccagg

SEQ ID NO: 706 - DNA, 255 bp, Homo sapiens
gacttccggcggaagaagaagccggtccggagttctggccgacagcaggcgaggagtgggtagcagcgcctatgtgaagttagctaatctgagaaggcccacttctggttccatggatgatggcggttgagcagatgccaaaaaaggattggtacagcatcctgggagcagacccatctgcaaatatatcagacctaaaacaaaaatatcaaaaactcatattaatgtatcatccagataaacaaagtacagatg

SEQ ID NO: 707 - DNA, 255 bp, Homo sapiens
cagccccagccgcatgacgcgcggaggaggcagcgggagcagccgcgggagccgggaccgggtagccgcgcgctgggggtgggcgccgctcgctccgccccgcgaagcccctgcgcgctcagggacgcggcccccccgcggcagccgcgctaggctccggcgtgtggccgcggccgccgccgccgctgccatgtctccggggaagcccggggcgggcggagcggggacgaggcggaccggctggcggaggaggag

SEQ ID NO: 708 - DNA, 255 bp, Homo sapiens
attctcggccgggctctaggcgccatggctccccgcgggaggaagcgtaaggctgaggccgcggtggtcgccgtagccgagaagcgagagaagctggcgaacggcggggagggaatggaggaggcgaccgttgttatcgagcattgcactagctgacgcgtctatgggcgcaacgccgcggccctgagccaggcgctgcgcctggaggccccagagcttccagtaaaggtgaacccgacgaagccccggaggggc

SEQ ID NO: 709 - DNA, 255 bp, Homo sapiens
aatgccgagtggtggcaagaggaggattagcttccactccgatttcaaagatccagtttacccactctacagcccagatatagtcacttatttcccctttccagccagagacttccgttccctgctggaacttccgatcccattcttctctcggtgggaatgcttgtggggggaaaaagaaacgcaatagataaagcggggcgcatgcgctcccggcacaggcttcgattgtgaggaaggccggctagtctccga

SEQ ID NO: 710 - DNA, 255 bp, Homo sapiens
gcagaccaaaaccacaagcagaacaagcaggcgtgagacactcacaggttgggtttgatcgcatgcgtgtcggagaggagagagcagagagagacacaggaacaagaacagcaaagggtagagcagacctgcgccaggggcgcacaacggccgtgtccacctcccggccccaagatggtgcttcccacaggcagccacgcgtagcagccagagacagctccagacatgtggctcttcttcgggatcactggattg

SEQ ID NO: 711 - DNA, 255 bp, Homo sapiens
acgccaccccgccctctccctctctgagagcgagatacccggccagacaccctcacctgcggtgcccagctgcccaggctgaggcaagagaaggccagaaaccatgcccatggggtctctgcaaccgctggccaccttgtacctgctggggatgctggtcgcttcctgcctcggacggctcagctggtatgacccagatttccaggcaaggctcacccgttccaactcgaagtgccagggccagctggaggtcta

SEQ ID NO: 712 - DNA, 255 bp, Homo sapiens
gctaaccccctaactcccgttcctcctcggcgtttcttctccaagtccgaagtcagggtccaggactgctgcgatgcatcagccccgcctctcatcccccatccagaggaggcggaaatgttcaggtgaacgcgaagcctcccactacgagccggccctcagcaaggccgtgcgcagtgtgggcgggagccctaagtcagctagcggcgacgctgggagggcccggagcaggccgggccccgaacagcgaaagct

SEQ ID NO: 713 - DNA, 255 bp, Homo sapiens
ctcctagtcgcagcaagcgcggaactggggttgcggcgtctaagtgtttccggtggattcccagggactgtcggaggtgtggactctgcctgcctacctggtctgggaagatgttctaccatatctccctagagcacgaaatcctgctgcacccgcgctacttcggccccaacttgctcaacacggtgaagcagaagctcttcaccgaggtggaggggacctgcacagggaagtatggctttgtaattgctgtca

SEQ ID NO: 714 - DNA, 255 bp, Homo sapiens
gcagcggcgcttcctggtggtcagggcgccatggcgctgtcctggctgcagcgcgtcgagcttgcgctctttgctgccgccttcctgtgcggggccgtggcggccgcggcgatgactcggacccagggctccttcagtggtagatgtcccctgtatggtgtggccaccctgaatggctcctccctggccttatcccgtccctcagcaccatccctgtgctactttgtagctggggcctctggcctcttggccctc

SEQ ID NO: 715 - DNA, 255 bp, Homo sapiens
gaagctgcgaggcgcatgcgcgttgcagggccgtccgctctgctgccgccgctgttgcagccaccgccgttgccgcctccctgccggcaagtgtgtgaagaagaagctgagcgttgtcgccgccgctatggggagaaagtcaagcaaagccaaggagaagaagcagaagcggttggaggagcgagcagccatggatgccgtttgtgccaaagtggacgctgccaacaggcttggagaccctctggaggctttccc

SEQ ID NO: 716 - DNA, 255 bp, Homo sapiens
agttaggtcatgaggctttggccttgacaccaagggatgctgtctccttgccggaagcagctcaccaaagccggcagagaacccaggttccgtggggccacgatgtggggctccgcgggcgccccggcgctggccgacttcctgtctcctgggtcagatgctgctccgcactgcagctatggtcgcatgcagtgcctgccgaagcccgcagcaggaatgctgccttcggtgattttaatttcacttttctacttc

SEQ ID NO: 717 - DNA, 255 bp, Homo sapiens
agccattcctgaggaggactgccggtcgttcggacgtcttgcctgtcgctggaggagaggtccgggctctccaggaaggtggctgcggcgacaaaatgaagatattcgtgggcaacgtcgacggggcggatacgactccggaggagctggcagccctctttgcgccctacggcacggtcatgagctgcgccgtcatgaaacagttcgccttcgtgcacatgcgcgagaacgcgggcgcgctgcgcgccatcgaag

SEQ ID NO: 718 - DNA, 255 bp, Homo sapiens
gcttctgccctcaaccaaaatggcgctagctcggaagctgccgaggtgctaggagttgccgaagcaagtccggaagctaccgagcgagtccggaagttgccgaaagggagcagcggggaaggaggatggcggatatcatcgcaagactccgggaggacgggatccaaaaacgtgtgatacaggaaggccgaggagagctcccggactttcaagatgggaccaaggccacgttccactaccggacgctgcacagtg

SEQ ID NO: 719 - DNA, 255 bp, Homo sapiens
gccgcgcagccgggcccgctcctcctccgctccgccagtgtccggccgcgggccggccttagtgactggggcggcgggccccggggccgcggcgtggggcgggcaggcggacgccggccgcgggctgctttcgtcggctcccaagctctcccggagcgagcagccgcccgcgagccgccgcggagcctcctcgcccgctcccgccggcgagcaagatgatgtgcgaggtgatgccgaccatcagcgaagcagaag

SEQ ID NO: 720 - DNA, 255 bp, Homo sapiens
gccagaggggctaggatgagagacagagggtgtgatggtgggtgctgggagatgtagccgaccttggggctggtggctgggggagtgggtagcctgggaaaggccaggatgtggacggactggtatggcattgagcctgaagtggtccaacttggggttccccagtgcctaggaaagttgtccccttgaatgtcagtgtgaaggtgaaggaggaagcagatgcctgttcatatggaaacaaagacctggctgtga

SEQ ID NO: 721 - DNA, 255 bp, Homo sapiens
gtcgccatcttgccccttcagaggcaccgcaaacaaacccaattcctggtgtcccctagtcttggcggaggagccttttagatgagccccgaaaggccgggcagggaggacaagctctttggggctaccaaacagaagcagcaatgcctgttgtgtggccaacccttctggatctcagcagggatgaatgcaaaagaattcttcgaaaattggaattggaggcatatgctggagttatcagtgcacttcgggcac

SEQ ID NO: 722 - DNA, 255 bp, Homo sapiens
gccaaagcgttacttccggcggaaaaggacgcgggagattcgattggaaggctgccggcgtgctactgagttcggccggtccgagtcactgtgcgtcgcctgggcccgttcctggtcttctcccccagggtcttgctctgtcacccaggctggagtgccatggcatcatcatagctcactatggccttgatcctcctgccttagcctcccaagcagctggtattacagaccacggtgtgaacacatgaacagaag

SEQ ID NO: 723 - DNA, 255 bp, Homo sapiens
gggagccaccaaaatggtggtgttcgggtatgaggctgggactaagccaagggattcaggtgtggtgccggtgggaactgaggaagcgcccaaggaaatgaaacacgatttccaaaatgaacttaatctttcatgagaaactgaggatagagatgtcaataagcagccactgtttccacctccccacctgaagagctaggaggacaactacaaagagcctgactgccttctcggaatgaggagagaggaaaacag

SEQ ID NO: 724 - DNA, 255 bp, Homo sapiens
aaaaccgggtgtaagccccggaagtacttgttgcctgagcagtgggctgcttaggaagagaaggtcagagttcgcgggggcagaggcattcttgccgctggcccagtcactatgtagtggaggggcagacaccctcccgcaaattctggaaggttcttagtctcgactagggcagtagccccaggactcctagtcgccggcttcaggtcactgccggctgaacggagctgccgtcgccatgtttggctgcttggt

SEQ ID NO: 725 - DNA, 255 bp, Homo sapiens
gtgctcgcgccaacccctacgccccagcgcgccttctccacccacgcacgggcctcggacgcatttccagccccggcgttggttgtggatgctggacatccaccgcctccaggcagtttcgccgtcacaccgtcgccatctgtagccaaagcaaaacatatcctaactgagactttgcagctcttgtggccactctgggctcaccgggaacatgagtggaagagcccgagtgaaggccagaggcatcgcccgcag

SEQ ID NO: 726 - DNA, 255 bp, Homo sapiens
tcttccttcccttgcttcccatttggttcagaagacacatgttttgtataattgagagtagcgatagaggggtgtgttctgaaattctggttaatttccctcagggaacaaaggacagcagagagcatggcttctactcaccagaatagactgcattgctttcgtagatatgtgaactggccttgatgtctagggttatggtgtagtattcatcaaaggtgaagcaggtgctactgtaccttataaaggtggcag

SEQ ID NO: 727 - DNA, 255 bp, Homo sapiens
agtggaggagctgctgctggtgctggggccggaggagggacgcgccggagcgggaccgacgggaccgagcgagcgaccgacgcgccacccgccgacgcctcagccgcttggggcccgcacggaccctctacttcagtgtagaatgagccaaggagactcaaacccagcagctattccgcatgcagcagaagatattcaaggagatgaccgatggatgtctcagcacaacagatttgttttggactgtaaagacaa

SEQ ID NO: 728 - DNA, 255 bp, Homo sapiens
gacgtaacttccggttgctgtgctgagtcggaagtgggaacccttcggccgctgagattctgtcgtgtcgtcgctgctggcacttcaggctctgcctctcccactaggtctggatggaggataccttaaagtgaaatgacagaccaggagaataacaacaacatctcaagtaacccctttgctgctctttttggctccctggctgatgccaaacagtttgcggcaatccaaaaagagcagctgaagcaacaatct

SEQ ID NO: 729 - DNA, 255 bp, Homo sapiens
tgacgcatactatagcgctgttttcctgcactgataaacgaaaagcaatccaccaggtctcggcagctaactttccggcactacttatgcccgagcgtgtcgctcccagtgcgcaagtgcagcaggtggctgcacggggggcgcgggaggaggaggaggaggaggaggaggctggggtggggccggcggcaagtgctgtgatgcggttccggggaggggccgtcgggtagaggctgaataccagtttccgagcgg

SEQ ID NO: 730 - DNA, 255 bp, Homo sapiens
atctgccgtcatatcagcttatggcgccggtcgctgattggctggccgctccagcctcccggcccgcttgctggctgcccagctgctaggacagtttgcagagcagtggcgtgcggagcggcggcggaccacctccaggggctaagtgatggatcttgtactccgtgttgcagattactatttttttacaccatacgtgtatccagccacatggccagaagatgacatcttccgacaagctattagtcttctgat

SEQ ID NO: 731 - DNA, 255 bp, Homo sapiens
cggttctttccggaaattatgactgcagctgttttcactccgctgtgactcagagcgctccgggctgcaggagaggaagcccagcctgttctaccagagaacttgcccaggtcagaggtctgcgtagaagcccttttctgagcatcctctcctctcctcacacctgccactgtcctctgcgttgctgtcgaattaaatcttgcatcaccatggtgcacttctgtggcctactcaccctccaccgggagccagtgc

SEQ ID NO: 732 - DNA, 255 bp, Homo sapiens
attggcctggagccagccaacgggggagcggtccgggaggcggacccggctcctgccagggttgggtgcgccgctgaacggatggctgagggagccccgcggatcgtttaggaaagccggccagctgatcgtcgtgtgttgccacccattcatgtcaagatgactaagtttggatttttgcgattgtcctatgagaagcaggacacacttttgaagcttctcattctgtcaatggctgctgtattatccttctcc

SEQ ID NO: 733 - DNA, 255 bp, Homo sapiens
gcccggagccgccgaagcgcctcggtgcgttgcaccgccggaggctgggcagctcgcagcgctgctcggcgctggaccccacccggcaggcgcaggccacccacacccggctctgtgcggctgccccccgcagcattgcacggccgaccctcgcccgcccactgccaccggccgcgggactggctgggactggctcggccgagggcactgctcctcggtgcattgctgctcgggcgccgcagcccgcagccgcca

SEQ ID NO: 734 - DNA, 255 bp, Homo sapiens
gcttctgagcggaaactgaaagtgaaatagggagctggctaccagcgttgagtcccctgtaaagccaaaccccctaaaggtctccacactgctgtttaacggcacacttgacaatggcttcagcagcacgcttgacaatgatgtgggaggaggtcacatgccctatctgcctggaccccttcgtggagcctgtgagcatcgagtgtggccacagcttctgccaggaatgcatctctcaggttgggaaaggtgggg

SEQ ID NO: 735 - DNA, 255 bp, Homo sapiens
agagtgctaaatttatcttcagaccggcgaccgcgccagccgcgaatcggatctctatggagatggcctaggcgatatccctgagctgagagcatcaccctgtccccgaatccttctttcctctctgttttgtttttcattcccctccctctctcccctccccctccagtccacgacgactggctgttgaccctgttcaggcctcggtgaaggcttttggttactccccttcccaccccatcccttaattttatt

SEQ ID NO: 736 - DNA, 255 bp, Homo sapiens
ctcctccgcagcttccggcacggccttcaagcgcgggacgcgacaaagtcatggaccgcaacccctcgccgccgccgccgggtcgcgacaaggaggaggaggaggaggtggccggtggagactgcatagggagcacggtctacagcaaacactggctcttcggcgtcctcagcggactcatccagattgttagccctgaaaacaccaaatctagctcagatgatgaggagcagctgacggagcttgatgaagaaa

SEQ ID NO: 737 - DNA, 255 bp, Homo sapiens
tgaaagcggaagtagggccttcgcgcacctcatggaatcccttctgcagcacctggatcgcttttccgagcttctggcggtctcaagcactacctacgtcagcacctgggaccccgccaccgtgcgccgggccttgcagtgggcgcgctacctgcgccacatccatcggcgctttggtcggcatggccccattcgcacggctctggagcggcggctgcacaaccagtggaggcaagagggcggctttgggcgggg

SEQ ID NO: 738 - DNA, 255 bp, Homo sapiens
ctgtgggtctgtaggttaagggagaagatggcggcgctaggggaacccgtgcggctggagagagatatttgtagagcaattgaattattggaaaaactacaaaggagtggagaagtaccaccacagaaacttcaggctttgcaaagagtccttcaaagtgaattctgcaatgctgtgagagaggtatatgaacatgtctatgagactgtggacatcagtagcagtcctgaagtgagagcgaacgctactgcaaag

SEQ ID NO: 739 - DNA, 255 bp, Homo sapiens
ggtgaatgggctggtggtgctcgctgctgctgctgagaggaggaggaggatgaagagttgggcttgtttgtctcctacagtttctctcctgctgctctgattcccccctcccgattccggcccggggcctgtgtgtgtccctcctggaggaggaggaggatccagttcctccccccaaccccctcctccccacccccccttgcctggggaagaggaggaaagaaacagcccagagagagagagagagagagagtg

SEQ ID NO: 740 - DNA, 255 bp, Homo sapiens
gtctgtttaaggaatagcagaagacatgacatgtagacaaatttcaggttattttcagaagatactgggtttgttactgtattttaaaaggatactttcttggtttgttatgagatattctaattaaacagtgatgaattcttactcctggtcagtgtaagtctaaattcaagtttgttgctttgttttacagtttcctttcactcccctcccccatcccctcatgagtcataagcatgcagtgttgggaataga

SEQ ID NO: 741 - DNA, 255 bp, Homo sapiens
agaagagcgatgggagggggtgacgtggcagtgacaggcgcataaactgaaatgaatggcggaaacagcagccaatcggcgatcagattggccgggcattccgcattctcccgtcctccctgagcgctggaaacttcaggaaagcaccaatgagcttccccaaaagtctgattggcctttatctgaaccaatcaaaggtgggtctggcggacgcgtcccaccccaggctctcactgggcgctgtagaatgacagg

SEQ ID NO: 742 - DNA, 255 bp, Homo sapiens
tctatggccagtctggccgccatgttggagctttcgctgttcggggcccggcctgctccgggccctcccagcgtcgccgctagctgacttagggctcccgcccacactgcgcacggccttgctgagggccggctcgtagtgggaggcttcgcgttcacctgaacatttccgcctcctctggatgggggatgagaggcggggctgatgcatcgcagcagtcctggaccctgacttcggacttggagaagaaacgcc

SEQ ID NO: 743 - DNA, 255 bp, Homo sapiens
gtttccggaggagtgtgtccgcgcaattgaacgactttatgtcacttcctatcggatcggcggaagttgcttccgagcgcgttgagctttggcgaagtgggttccggtggtggcagaggtgcttgtgtttttgtcggtacaggagagtcgctatggcggcggtggattcggatgtcgaatcgctgccgcgtggggggttccgctgctgcctctgccacgttactacagccaaccgacccagccttgatgcccact

SEQ ID NO: 744 - DNA, 255 bp, Homo sapiens
agatccttgaaagggttttggttttgactgagcagaatggtgccattgcagatcaacacgcactttaaataatcaaaacccctatctttcccctgggaaggaggaagccgaggaaggctgtgtttctgactcacacgggggagtcgggggagtcgtaaacaaccctgaagagaacagccaggcctggcgctctgggcttggtcctgggacacccgtttgacactgtaaaggtgaggctgcagacccagaccacct

SEQ ID NO: 745 - DNA, 255 bp, Homo sapiens
cttgctccggcctcctcgctcctgcctgagttcggggcctggtctgggcttcgtcctggggctgggaagtttctgcgctccccgctgtccagtctgcatctccgcgcctcccgccgggcccccgcggtcccctcccgcccgcttcccccgctgccctccctcgctgccccctaccctctcccggggctcccggccctctactcccttcgggcgcgggcccctcgccccgcccgggcgcgccccccctcccccggg

SEQ ID NO: 746 - DNA, 255 bp, Homo sapiens
agcgccggaagtacggttttcggagggatcagactcagactcacgtcgcactcctcgcagttggactggtgggaactgggaacactggagacctgatttctaactgacgctaccgtcgcggccgccggcaagttcctttactgtgttttcttggttcagccttgaagtgagtcgtggacgatcctctctcagcgtccagcctagacggcggtgttgctccggcagcgttcctgggagccgagggccagagactaa

SEQ ID NO: 747 - DNA, 255 bp, Homo sapiens
gcccctggcctcccgcgagctgcgcaccgccggccgctgccccagctgcccgagcccgcgccctcgtccgcgcgacccggcggggggctccaggccggcagcatgagcggcggcggcgacgtggtgtgcaccggctggctgaggaaatcgcctcccgagaagaagttgaggcgctatgcctggaagaaacgctggtttatcctgcggagtggccggatgagcggtgacccagatgttctggaatactacaagaac

SEQ ID NO: 748 - DNA, 255 bp, Homo sapiens
aaaaccactgacttccggctacgccgttgtctgggtggcgcggtcgagtcatcgcagggcctcaccgcttcgttctcccgtccctccccgcgccttggcgcggggggtcgactagccaagtgaggcgggaggcgactcggacctttccctgcatttcgtttcggccagtgccgggggctacccgccctggggcctgggatccttggggcccgtgaggcccactcttagcggccggggcctaccgcggcccgccgc

SEQ ID NO: 749 - DNA, 255 bp, Homo sapiens
ggagcctggcgccgccattttcctgcagctgcctgttcctcttaccctgcccggctccagctgaccagggaaggggtgggctgaactgaggcgggggcaagggagtgcccgacatcttgtccgactccgcgggtgacacgagccggttctctctggactggtggcagcgcgcggccccgaaccgcgccccaggccggcaggcggggaaggagccggtgggggtagggggtgcggtggggggtggggaccctccgg

SEQ ID NO: 750 - DNA, 255 bp, Homo sapiens
ccctccgggcaggggaggtaggcctgggcctgacgccggccacgcagcggcgggagagtgagcactcgggcggcggcgtcctggagacccgcgagagatggaagcggcggcgacgccggcggctgccggggcggcgaggcgcgaggagctagatatggatgtaatgaggcccttgataaatgagcagaattttgatgggacatcagatgaagaacatgagcaagagcttctgcctgttcagaagcattaccaact

SEQ ID NO: 751 - DNA, 255 bp, Homo sapiens
gaggagcatcgcttgtcctgagctggttgccggggcaggggcggaggcggaggcagaggtggaggcgctttgaaagccgtcattgtgtggcactggacggggaatcaagagacccggtttctaatccctgctctgtcactaacaagctgcgtgatcttcggaaaaaagtaatcctcttggaaagctggaaacatagtccgaagcttaagtgaaaatgatacatgttagaagacatgaaacaaggagaaattctaa

SEQ ID NO: 752 - DNA, 255 bp, Homo sapiens
ggcgaccgtggggaggtgccgccggggtcgcaggtgagcggttctatgctggaggaggcggccagggaagcggcggctccgtgaccagtgggtgccctcgcagtgggtagggtcccggaggggtcagcggcaattggcgcaacgcttgctgccgggtttggtccaagggctgcgacgtagcgggactgcacgctcgggagaagtgccacgcgcgtctgtcgcctgaccggggaggctggggagggcccaggccac

SEQ ID NO: 753 - DNA, 255 bp, Homo sapiens
ggatgcagcagagaggagcagctggaagccgtggctgcgctctcttccctctgctgggcgtcctgttcttccagggtgtttatatcgtcttttccttggagattcgtgcagatgcccatgtccgaggttatgttggagaaaagatcaagttgaaatgcactttcaagtcaacttcagatgtcactgacaagcttactatagactggacatatcgccctcccagcagcagccacacagtatcaatatttcattatc

SEQ ID NO: 754 - DNA, 255 bp, Homo sapiens
aacagtctgggacatttcagactggcaccacctcctctggctgtttccgaggccatctagaggccagagcccagtcagattaactgaaagtaaagagaggactgcgggagtttgggacctttgtgcagacgtgctcatgctcgttcgtgtagagggcgggagagaggaaaggaaggagggcattgggagctgaggccccacctttcatttcagaaaagtgcacaggcagagcgggctgagtcacaggcacaggtg

SEQ ID NO: 755 - DNA, 255 bp, Homo sapiens
acagcagttacactgcggcgggcgtctgttctagtgtttgagccgtcgtgcttcaccggtctacctcgctagcatgtcgggccgcggcaagactggcggcaaggcccgcgccaaggccaagtcgcgctcgtcgcgcgccggcctccagttcccagtgggccgtgtacaccggctgctgcggaagggccactacgccgagcgcgttggcgccggcgcgccagtgtacctggcggcagtgctggagtacctcaccgc

SEQ ID NO: 756 - DNA, 255 bp, Homo sapiens
ggagtgcccaggatggagtgcagtggctattcacaggtttaatcatagctcactaccgtcttgaatccctgggctcaagtgatcctcctgcctcagcccctgagtagctggtactaaagttaccttccacgctgtatgtccgtgagaaatacaatgaagacggtctgaataatgaactggtaatcttcgataatatgaaacgaatttaagagaacatatcaaagagaaggctctcaaaataggctgctgcaaaag

SEQ ID NO: 757 - DNA, 255 bp, Homo sapiens
aaccgtccccaacggtcgccagcgcgcggctcccgggccccctcgctcctcccctctggcccctccgagcgctgggggtgcttccctccccgcctcctcgcactcccactcgcgggcacgccggtggctgtgccgccatgccccaccacaggctgctcacgggcctaggcgcggcggcccgagataggggcccctgagcctcccgggggaggagagaggcagcgagccgcgctccgccccctccccccgggccgc

SEQ ID NO: 758 - DNA, 255 bp, Homo sapiens
cccagttgtgcatgtctgatgtaatttcacatatgaatgtatgaattacttgtcttattcatgttgatacagcctcagtccatggcgcatccgtgtggggggaccccaacatacccagaatcacagatatttttcccaactattcatgaacgtccagtttctttttcaccacctcccacctgcccaccgaaagtagccatttcccagcggcgtaagagcacctccttcctggaagcccaaactcaccacttccaa

SEQ ID NO: 759 - DNA, 255 bp, Homo sapiens
cgcggcggcggcagcggcggcggctacaccgggcttggccccctccctcctccgttcccccctcctcccccctcccctcagcggtggctcccaagaagtccgagacacgcggatcaactcactatcctgaaggtccattctcccaagaagaggggacagaaagacagatctatttgtaagaaaggcttgggtatcccatgaacgagccaacagaaaaccgattggggtgcagcaggactccagagccagatataa

SEQ ID NO: 760 - DNA, 255 bp, Homo sapiens
agagccgcgggtgagatccccagccctgtgagcctgtaggagtagaatggctccccaaatgtatgagttccatctgccattatccccagaggagttgttgaaaagtggaggggtgaatcagtatgttgtgcaagaggtactgtccatcaaacatcttccaccacagcttagagcttttcaggctgcctttcgagctcaggggcccctggctatgctgcagcactttgatactatctacagcattttgcatcactt

SEQ ID NO: 761 - DNA, 255 bp, Homo sapiens
attggcctggcaggcaggatcgaggaggaagtggctgattactgagcggttcttcctcacctggcttgggccactgtgcacagctgtgccgctggctcagccccgccccctgcggccctctgccgtggcttccccctccctacagagagatgctgtcccgtgggtggtttcaccgagacctcagtgggctggatgcagagaccctgctcaagggccgaggtgtccacggtagcttcctggctcggcccagtcgca

SEQ ID NO: 762 - DNA, 255 bp, Homo sapiens
ctttgaaaaagacttcttttgagctaactttcttatactggtacctttctaatctcactacaatatgtaacattggtgttcgatctcaagtatttctgaatatattcccctatccacagaaatatactctgggggaaaaaaaatagaacaaattcttgccgtcctgaccattgaacaagagactaattagacaatggggctagaaaaacctcaaagtaaactggaaggaggcatgcatccccagctgataccttc

SEQ ID NO: 763 - DNA, 255 bp, Homo sapiens
cttcttcgtcagcctcccttccaccgccatattgggccactaaaaaaagggggctcgtcttttcggggtgtttttctccccctcccctgtccccgcttgctcacggctctgcgactccgacgccggcaaggtttggagagcggctgggttcgcgggacccgcgggcttgcacccgcccagactcggacgggctttgccaccctctccgcttgcctggtcccctctcctctccgccctcccgctcgccagtccatt

SEQ ID NO: 764 - DNA, 255 bp, Homo sapiens
atgatctccttaacggacacgcagaaaattggaatgggattaacaggatttggagtgtttttcctgttctttggaatgattctcttttttgacaaagcactactggctattggaaatgttttatttgtagccggcttggcttttgtaattggtttagaaaaaacattcagattcttcttccaaaaacataaaatgaaagctacaggtttttttctgggtggtgtatttgtagtccttattggttggcctttgata

SEQ ID NO: 765 - DNA, 255 bp, Homo sapiens
acaatacaaagatgattgcagttgtccctggtaagctcagcccacagagcctttcaattcagcttggggtgagctgcacttcaggcatggggatataatagtgtgatgaaccattcttctgaaggttcttctgaaaagctgctggtcttgggatactgtgagagcccctctcattgctctttagaagtaatttaaatttttctgctacattgtctgctcagctcgtattctggtcatagaggaacctgaagccag

SEQ ID NO: 766 - DNA, 255 bp, Homo sapiens
ggagggctggttaccatggaatccaccatctgttcactccccaccggaatgtgattatccttgctgggctgggaagtggggaaagcaggggagcctgtgctgggtgagattatctgcaatggaccgggttaatgggaggcttgctttggctcgctggaagaacaaatgaagggagttttacttcaaccatttgtgacttctggccaagaggaataaattcagcttttataaggcagcagtacctgtccaaagatc

SEQ ID NO: 767 - DNA, 255 bp, Homo sapiens
gcgtgccgctccgccgaccgaagaggctggacatgacaccagtggcatatcacggccatggggtctcagcattccgctgctgctcgcccctcctcctgcaggcgaaagcaagaagatgacagggacggtttgctggctgaacgagagcaggaagaagccattgctcagttcccatatgtggaattcaccgggagagatagcatcacctgtctcacgtgccaggggacaggctacattccaacagagcaagtaaat

SEQ ID NO: 768 - DNA, 255 bp, Homo sapiens
acagtgctgaagcgggggtggggcggaggcgagtctgcgggggttttggggggtgtcgaggcctctattctgccccagagcgctggcgaaggccccttctcagcccgccttttcctttctcccgctccttctcctctactaagtgtagacgcagggccccttggcctagcttcgatcgttcgaattcagagcacgtccttccgaggtgaaggaacgcgaaactccacccatccgattgctgttcggctgcgggcg

SEQ ID NO: 769 - DNA, 255 bp, Homo sapiens
aagttcaaagccggcctccagccagagtgacggcctgcgcggactcccgccttagtgggcggagttgtgccgcgtctgatgcgcagttccctttatagcgcggcaagccgaatcctagaggctaacccggcaggtgggagggagaaagttgctttctgcaccaatagctgaggcgttcagggttgtccagggacgctaccctcacgtgtctggttccgagtgctgcgttcggctgtgctgggaagttgcgtagac

SEQ ID NO: 770 - DNA, 255 bp, Homo sapiens
tttgttgtctaatcatcagtcgagcggccacataattaccaattaggcagtagcagaggcgggtgccgaagcacggggtctgggtgactaggaagagccgagactgcgaaggagaacgcagcaagcccaggcggcggtggaaaggctggaggacacacctaaacatgtggaatcccaatgccgggcagccagggccaaatccatatccccccaatattgggtgccctggaggttccaatcctgcccacccaccac

SEQ ID NO: 771 - DNA, 255 bp, Homo sapiens
gcggccgcgtctgcctggcccgtcccctccagcccagctcgggctccagctccagcgccggcgcttcagctgcgaccgcgagccctctcaagcaaggtagagaccccgcgagccccccagcgccccaccctcccccatcggaaaaggacaggggtagggaagccgaggacccacgggctgcgttcgtgctgctgggtcgggaaggaggaagcgtgacagctggagcgggcctaccctctgaagaggtccaagcaa

SEQ ID NO: 772 - DNA, 255 bp, Homo sapiens
ccttccttcctctcccaggcccgagccatggcaacagcgtgacgtgggggtaccgagatctgcgggagcagcggtcccggcttcagttctagcctacccggcagcctggacgggagcaaggcgagaggtgctgccgcctcccgtcgcccctgcgctcagaggtcccgaaccagcccagccgctgcctcttgccgctccgcctttggagtgaggagggcgcagcccgcgtcagaacttagagggccaggcagggtc

SEQ ID NO: 773 - DNA, 255 bp, Homo sapiens
aatccagaggcaggggagggacggtgcaggcgcagagtattgggtttggctggcctcgatttaaagagacagaagctgtcggggtcctggaagacggtccccaataccctccccccaagtccttgggaccacttgggtccccagagctggggagatggtttgtggcggctttgcctgctccaagaatgcgctttgcgctctcaacgtggtctacatgctggtgagcttgttgctcattggagtggctgcttgggg

SEQ ID NO: 774 - DNA, 255 bp, Homo sapiens
gaaggagccgccatttgccaccgccgagcgcacgggccgagccaagcctgatcccggagccggagggggactgggaccgagagaacggcgatggggggcggccccgccgcaggaggacccgggcgcgtaaccccgggggcccggcccgctccagacccagacccgcggggtgcggcaccctgagcccccctccccgccccctgccctggccatggccgcccaccccgccgcccccgggccgccagcccgctcggc

SEQ ID NO: 775 - DNA, 255 bp, Homo sapiens
agcttgtaaaacaccctggagagaaaatggcggcggcagcagcttcggcgcctcagcagctctcggatgaggagcttttctctcagctccgccgttacggcctgtctcccggaccagtgacggagagcacccgcccggtctacctcaagaagctgaagaagcttcgagaggaagagcagcaacagcaccggtcagggggccgcggcaacaagacgcggaacagtaataacaataacacggcagccgccacggtcg

SEQ ID NO: 776 - DNA, 255 bp, Homo sapiens
gacctggactccgcctcgtccccggggctcgggcagccgagccatggcggggaactgtggggcccgcggcgcgctgtcggcgcacacgctgctgttcgacctgccgcccgcgctgctcggagagctctgcgctgttctggacagctgcgacggcgcgctgggctggcgcggcctgggagcagtgttgagtccttcagagaagagttatcaggaaggtggatttccaaatatattattcaaggaaacagccaatgt

SEQ ID NO: 777 - DNA, 255 bp, Homo sapiens
atgcaacgcgtaagactgcgacggtaccggggcggcggggaaggaccgagaggcgggaggagcagcggctcaggcgcctgcaaactggtggcctgaacgaggtagaccatgactgtggtttcagtggcgtcactcgctgggctgctcttcctgaggttttcctaagccatcccctggcggaaccgcccccagtttttgtccagaagtgcttatagaaaagatggctaatattaacctaaaagaaataaccttaat

SEQ ID NO: 778 - DNA, 255 bp, Homo sapiens
ctcgctctgtcgcccaggctggagtgtagtggagccatctcggctcactgcaacctccgcctccccggttcaagcaattctcccgcctcagcctcccgagtacttgggattacaggcgcccgccacctcgcccggctactttttgtatttttaatagagacggggtttcgccgtgttggtcaggctggtctcaagctcctgacctcaagtgatctgcttgccttggtctcctaaagtgctgggattacaggcgtg

SEQ ID NO: 779 - DNA, 255 bp, Homo sapiens
cgcgctgtccatgtcgcgggcctcgctgggactccctgggagatgaggccgcgaggtctcccgccgctcctggtggtgctcctgggctgctgggcctccgtgagcgcccagaccgatgccaccccggcggtgacgacagagggcctcaactccaccgaggcagccctggccaccttcggaactttcccgtcgaccaggccccccgggactcccagggctccagggccctcctccggccccaggcctaccccagtc

SEQ ID NO: 780 - DNA, 255 bp, Homo sapiens
gggctccgcgcccggccagcctgaggtggggtcggtgcccccggcggcacggcgctggggaggcgatggcgccggccgcgtccaggctgcgggccgaagccgggctcggggcgctgccgcggcgggcgctcgcccagtacctgctcttcctgcggctctacccggtgctcaccaaggcggccaccagtggcattttgtcagcacttgggaacttcctggcccagatgattgagaagaagcggaaaaaagaaaact

SEQ ID NO: 781 - DNA, 255 bp, Homo sapiens
tgcgaggcagctcgctcgttctgcgatctattgagagtggcttccaagagccccgtgcctatgtctgggagggagggaagatggcagccgtggcggcaggcggcctggtgggaaaggggcgcgacatcagcctagcggccctgcagcgccacgacccctatatcaaccgcatcgtggacgtggccagccaggtggctctgtacaccttcggccatcgggccaacgagtgggagaaaactgatgtggaaggaacct

SEQ ID NO: 782 - DNA, 255 bp, Homo sapiens
agattgcttcaggggggtggggtggggtggggtggggctgggggcttgtcgccctttcaggctccaccctttgcggagattataaatagtcatgatcccagcgagacccagagatgctgtaatggtaagactttggatccttcctgaggacgtggagaaaacttgctgctgagaaggacattttgaaggttttgttggctgaaaaagctgtttctggaatcacccctagatctttcttgaagacttgaattagat

SEQ ID NO: 783 - DNA, 255 bp, Homo sapiens
actgtggctaagtgtggggaccagacaggactcgtggagacatccaggtgctgaagccttcagctactgtctcagttttttgaagtttagcaatggcgtctttctctgctgagaccaattcaactgacctactctcacagccatggaatgagcccccagtaattctctccatggtcattctcagccttacttttttactgggattgccaggcaatgggctggtgctgtgggtggctggcctgaagatgcagcgga

SEQ ID NO: 784 - DNA, 255 bp, Homo sapiens
gagcccggagcaggccgggctcaagaaagaggaaagttgaggacgccccacctcggagaggcggcgcccctgagtaggccaggagcctctcttgcaacttctgccaccgcgggccaccgcggccgcctgatcccgcagaggaaggtcgcggccgtggagcgatgacccgcggcggtccgggcgggcgcccggggctgccacagccgccgccgcttctgctgctgctgctgctgctgccgctgttgttagtcaccg

SEQ ID NO: 785 - DNA, 255 bp, Homo sapiens
gcgggaacgcgcgttgggggtcaggtgccggaagaggaaacctctcgctggggctaggagttcggcggggcgcgcgccggcggctgcggagctggcaggtgcgaagcgtctgcacctggcgggcgatggcgcccgatgcgggcgccccgggatagcgtgggcgaggctgcggggccccggcgcgcacgcccgcacctctccccagccctggcgtgggcccagcccggcccaggcagcaatggggttcctgcagct

SEQ ID NO: 786 - DNA, 255 bp, Homo sapiens
aacactcatcagtgcgcaggcgcccatcttagttggtcttctagtccggtaaacagagggcctgcccccgacagcttctgcttccgggtcacgccttgacagcggctttcaacccccacctcagcccagcaattcggcagtttggagcatgtgaacaccttgagccttgatgagttccagtatgtggtatattatgcagagcattcagagcaaatactctctctccgagcgcttaatccgaacaattgctgccat

SEQ ID NO: 787 - DNA, 255 bp, Homo sapiens
gtgtcgtcactagatctcttaaaaagatggaccctcagcggcgcttcctcgtagcgagcctagtggcgggtgtttgcattgaaacgtgagcgcgacccgaccttaaagagtggggagcaaagggaggacagagccctttaaaacgaggcgggtggtgcctgcccctttaagggcggggcgtccggacgactgtatctgagccccagactgccccgagtttctgtcgcaggctgcgaggaaaggcccctaggctgg

SEQ ID NO: 788 - DNA, 255 bp, Homo sapiens
gagccggccgcctccgtccgccttgcttcggtgcggctgtccgctacgctgcctccgccctcgccgcgcgcccccgccagcgggactccagggaacccccggcgccctcgacggggccgaggagtcgggactcggggagccggcgctgagggaggagcctggtcggagccgcggagccgaaagctccggagcgtggaggtggggggccgaggcccctgagggggccccgccgcgatgggcaacctggagagcgcc

SEQ ID NO: 789 - DNA, 255 bp, Homo sapiens
cccgttagtcttttcttcacttccgttgagttccgcctcgccgtttgtcccttgcggtacccgtccgcatacgaatctagcccgggaaccgagttgcgggagtgcggtctgtgccgttccggccaggagtttgccgactgcagacgtcctgcgaaccggcaagatgtgctctctggggttgttccctcctccaccgcctcggggtcaagtcaccctatatgagcacaataacgagctggtgacgggcagtagcta

SEQ ID NO: 790 - DNA, 255 bp, Homo sapiens
gagaactcaggccgagggcttcagacgctggtgcgcctgcttggggctcctgtgctcagctcagcctgagcttccacactcagcgctcagcaatggcccgggggcggggcgcggtcctcgcagattctcaaaggtagccgggatcctcgtccagcagtgtcagctcaggctcagcctccccagagacaacaccgggagcctcatctctctcctcaccctgctgtgactccaccacaggtttctagagccatctgg

SEQ ID NO: 791 - DNA, 255 bp, Homo sapiens
ctgcttgaagcctaactgtccaccagaaaggactgctctttgggtgagttgaacttcttccattatagaaagaattgaaggctgagaaactcagcctctatcatgtggaacagctctgacgccaacttctcctgctaccatgagtctgtgctgggctatcgttatgttgcagttagctggggggtggtggtggctgtgacaggcaccgtgggcaatgtgctcaccctactggccttggccatccagcccaagctc

SEQ ID NO: 792 - DNA, 255 bp, Homo sapiens
gcccctctccccctttccctcctcccagcgcttgggggcctgtgcagtgggactgattgccgtgggtgtcggggcacagcttgtcctgagtcagaccataatccagggggctacccctggctctctgttgccagtggtcatcatcgcagtgggtgtcttcctcttcctggtggcttttgtgggctgctgcggggcctgcaaggagaactattgtcttatgatcacgtttgccatctttctgtctcttatcatgtt

SEQ ID NO: 793 - DNA, 255 bp, Homo sapiens
aaggggcagaaggagaggcgttacttcctggagacttcaggtgtggtagccggcgccgcgcccatagccggacggggatctgagctggcaggatgaatgtgggggtggcacacagcgaagtaaaccccaacacccgagtgatgaatagccgaggcatctggctggcctacatcatcttggtaggattgctgcatatggttctactcagcatccccttcttcagcattcctgttgtctggaccctgaccaacgtca

SEQ ID NO: 794 - DNA, 255 bp, Homo sapiens
ggagtctgcttagttctgaggactgcgtgggtccgcgcagagagctcctgctaggcctgcgcgtcccgttctaaattcttaccctttagtccttgtcaccacccccgccgtgggaacggcctgacagtcactcgtcaaaggaagtggctgccggcagctcttgacccggaatcggatcctagtcccaccccctccgctccaggcttccttctgcaacaggcgtgggtcacgctctcgctcggtctttctgccgcc

SEQ ID NO: 795 - DNA, 255 bp, Homo sapiens
cacctcctgtccgcccctcagcgcatgggtggcggtcacgtgcccagaacgtccggcgttcgccccgccctcccagtttccgcgcgcctctttggcagctggtcacatggtgagggtgggggtgagggggcctctctagcttgcggcctgtgtctatggtcgggccctctgcgtccagctgctccggaccgagctcgggtgtatggggccgtaggaaccggctccggggccccgataacgggccgcccccacagc

SEQ ID NO: 796 - DNA, 255 bp, Homo sapiens
ctcgctcggtgttcgcccgccgacgccgcacggcttgctggggctgggctcttcctcgcggaagtggggaggaggcggttgcggttagtggaccgggaccggtaggggtgctgttgccatcatggctgaccccgacccccggtaccctcgctcctcgatcgaggacgacttcaactatggcagcagcgtggcctccgccaccgtgcacatccgaatggcctttctgagaaaagtctacagcattctttctctgca

SEQ ID NO: 797 - DNA, 255 bp, Homo sapiens
cgaccaggttctccttccccagtcaccagttgctcgagttagaattgtctgcaatggccgccctgcagaaatctgtgagctctttccttatggggaccctggccaccagctgcctccttctcttggccctcttggtacagggaggagcagctgcgcccatcagctcccactgcaggcttgacaagtccaacttccagcagccctatatcaccaaccgcaccttcatgctggctaaggaggctagcttggctgata

SEQ ID NO: 798 - DNA, 255 bp, Homo sapiens
ctcagctccgcaccgcaactgaagatctgccgccgcggaacagttgcgtctccatctggctaccaacccacccaagctttcttctccaccaccaccaccttccttccttccccctcctccccctcctttccgtcttccctctccacccccgcccccaatctcctcctttttttctcactacgagcggttgctgatgctgaagccgagcgtcacttcggctcccacggcagacatggcgacattgacagtggtcca

SEQ ID NO: 799 - DNA, 255 bp, Homo sapiens
gttttacagttgagtaatctcagataaagacaggaacatggtgtttataagctgcccttaatggcagagaacacagacagaaacgagggaagagagagaaattggggaccctgaagaaagggggccagcagcaggtaggtgccatcagggacaagaacagcacctcccagggtgggagaccccaggcctttctggcagcaggtctggatggaaagtggacaggaggctcacccgtctgcatcccctgctcctgcc

SEQ ID NO: 800 - DNA, 255 bp, Homo sapiens
ccgggcgcgccacacttcctgttgatccggctcggccgggggctgggccggcgggcaggcggcggcggccactggccaggcgtggacgcgcgcggggccgccgcgggcacggagtggccgccgcgtcgcctgagcccagagccggggagtgctctcggccgccgcgtctcctgccctctgtccttccaacccagccctcggctgagccgcgccgcaccatgcccgccgtggacaagctcctgctagaggaggcgt

SEQ ID NO: 801 - DNA, 255 bp, Homo sapiens
ccggagcctgcggcgggcggctgtgacggccccggcgctgacggcggcggccgggggggcggtgtcgacgcccgcggcgccggctggggcatcaccgcgggcctcgaccccgaaatggcgctgctggccgaacacttgctgaagccgctgcccgcggacaagcagatcgagaccgggcccttcctcgaggcggtgtcccacctgccgcccttcttcgattgccttgggtccccagtgtttactcccatcaaggca

SEQ ID NO: 802 - DNA, 255 bp, Homo sapiens
acctccccgcgcgtgcgtgctgtgccaaggctgcaaggcgctgaggggagaggcgccgccgtcagcgccgccgcagctgggacccgttagagcggaagcgccgccgccaccgccgcctttgctgtcccccggcctctagttccccgcaggtgggaggtgggagccatgtcgaaacggctccggagcagcgaggtgtgcgctgactgcagcgggccggatccttcctgggcatcagtaaataggggaacgttttta

SEQ ID NO: 803 - DNA, 255 bp, Homo sapiens
attggttgcggttaagtgggcgggtcgccgaggagcctgaggaagagggcggcgacggtggtggtgactgagcggagcccggtgacaggatggctgggcacagattggtgttggtattaggagatctgcacatcccacaccggtgcaacagtttgccagctaaattcaaaaaactcctggtgccaggaaaaattcagcacattctctgcacaggaaacctttgcaccaaagagagttatgactatctcaagactc

SEQ ID NO: 804 - DNA, 255 bp, Homo sapiens
ggctgaggcggaggagccgccgcttctgacctcgctctggctccggtgcgcgcggctgagcgcgtgcgaggccccgcgcgtcgggcaggggcggcggcggccactgcgcgccgccctgaggagcgccccagcggcggcgcgactgcggctgaggagagagccggctccgggcctccgcgtcctcctgctcccccggccccccgcctcctcgggggggcggcggcggcgatgttctcggtcctctcgtacgggcgg

SEQ ID NO: 805 - DNA, 255 bp, Homo sapiens
ccttctgcgttcccagcgcgcggcccgaatggcggccgacaagggcccggcggctggacctcggtcgcgagctgccatggcccagtggaggaagaagaaagggctccggaagcgccgaggcgcggcctcccaggcccgcggcagcgactcggaggacggcgagtttgagatccaggcggaagatgacgcccgggcccggaagctgggacctggaagacccctgcccaccttccccacctcggaatgcacctcgga

SEQ ID NO: 806 - DNA, 255 bp, Homo sapiens
cagcaggcggggcacccggactggcggcttcgctggcgcaaggtcggtccggcggccagggacctggaaggctgcgaggccctgcgaggtcgaggttcggagtttgctggtcccaggcccggcccgaggccaccggagccgccagctgtttggaactgagctactgcagaaagggaagtggagagtaagggccaggccccgtgggggcagatggccggcagaaggctgaatctgcgctgggcactgagtgtgctt

SEQ ID NO: 807 - DNA, 255 bp, Homo sapiens
gaccattcagaagactgtccacccgtcctcagccccctctcttcgtgggctatctactcagttgatccctccctcgctggcttggctctgactcctgctcagacccatcacctttgccgggaatgatgtctggagaacccctgcacgtgaagacccccatccgtgacagcatggccctgtccaaaatggccggcaccagcgtctacctcaagatggacagtgcccagccctccggctccttcaagatccggggca

SEQ ID NO: 808 - DNA, 255 bp, Homo sapiens
cttccggacaggtcaggccaaggtctcagccacgtgactgtgttccggctcggtaaagatggcggcgcccagggcggtagcgtgaaacttggtggaagacgctgaccagtcgtgttggaatcaaaacagcggggaccctgcgccatgtcgcgactgatcgtgaagaatctcccgaatgggatgaaggaggagcgtttcaggcagctgtttgccgccttcggcacgctgacagactgcagcctgaagttcaccaaa

SEQ ID NO: 809 - DNA, 255 bp, Homo sapiens
ctcggacgcctcgctccgacatgccccgctctggcggccgggctcgcggaggatcatgactgcggcagcgaactgggtggcgaacggggcgagcctggaggattgtcactccaacctcttttcgctggctgaactcacgggaatcaaatggcgtaggtacaattttggagggcatggggactgtggacccataatttcagccccagcccaagatgatccaattctgttaagtttcatccgctgtctgcaagctaa

SEQ ID NO: 810 - DNA, 255 bp, Homo sapiens
gtcacgtggggctgcgcccaaggctgccgggagcagactgggctgcgggcggcggggccggcgcctgcctggagggatggggccgccgggcgcgtaggggccatgccgcccgggacccgggcctgccgcgttccgcgccccggccgccgcgccccacgtccgcgccgggatggtgaacctggcggccatggtgtggcgccggcttctgcggaagaggtgggtgctcgccctggtcttcgggctgtcgctcgtcta

SEQ ID NO: 811 - DNA, 255 bp, Homo sapiens
cgcacgcgcgcgcgcggcggccccaggtacgcggacaagatggcggcggcagcagtcgacagcgcgatggaggtggtgccggcgctggcggaggaggccgcgccggaggtagcgggcctcagctgcctcgtcaacctgccgggtgaggtgctggagtacatcctgtgctgcggctcgctgacggccgccgacatcggccgtgtctccagcacctgccggcggctgcgcgagctgtgccagagcagcgggaaggtg

SEQ ID NO: 812 - DNA, 255 bp, Homo sapiens
gtctccgcccgcgcccaccgccatgtgacgggaagcagctgatggcctctccgggcggcggcggcggcctggccggggcgggcggcgcgggggcggcatgagggcccgcggcccggggggctgaggcgcccgccgcctgccgcgggggccgctcgcgtcctccatggaggccggagaggaaccgctgctgctggccgaactcaagcccgggcgcccccaccagtttgattggaagtccagctgtgaaacctggag

SEQ ID NO: 813 - DNA, 255 bp, Homo sapiens
gtgctcggcgcagtccggtgcgattggccacccctggcaggagccgcacctcggacagcagcagcggcggcggccgcgggagggtccttgtggcgccgggcggcggggtcctgcgtggagagtgggacgcaacgccgagaccgcgagcagaggctgcgcacagccggatccggcactcagcgaccggacccaaggatccgccggggaacaagccacaggagagcgactcaggaacaagtgtgggagaggaagcgg

SEQ ID NO: 814 - DNA, 255 bp, Homo sapiens
ggcgcggggcggaacagatcgcagacctgggggttcgcagagccgccagtggggagatgttgaagttcaaatatggagcgcggaatcctttggatgctggtgctgctgaacccattgccagccgggcctccaggctgaatctgttcttccaggggaaaccaccctttatgactcaacagcagatgtctcctctttcccgagaagggatattagatgccctctttgttctctttgaagaatgcagtcagcctgctc

SEQ ID NO: 815 - DNA, 255 bp, Homo sapiens
aaggagggaggcggtggtagcggcggcggctgctgaggaggaggagggggagcggagggaggtgtttctgtcagttccggctgtttgttcgggaagtggatccgccgctgccggagcagcccgaagggagctgcggatcgcgaggccagtaccgaccccgcccgcccgcgcgcaccgcccccgcccgccatggcccgggactacgaccacctcttcaagctgctcatcatcggcgacagcggtgtgggcaagagc

SEQ ID NO: 816 - DNA, 255 bp, Homo sapiens
aggcgtcctcgtggaaggttcgtgtgctagttagatgggcgccaggggtcgccggcgggaagcatggaggggtctttgggggcctttgggaacatggagtcctattctgttccgcctggggcctcggtggcggcttgcacgccccgagatgacggccgctgccctaggcagggccggcgggcgattgcgcgtgtcctgctcctcttaggcccgggaccgcgggatgggtgtcggcgtgaccaggcctgagctccc

SEQ ID NO: 817 - DNA, 255 bp, Homo sapiens
cccctctgcatttctctcttctccagaccagctcctccactgtggctctgagtgccccggggctgtccagctctgctccgtcctcatactgctcccttcctccttctcctcctcccatgccatctgtatttctgccacccaccactataccctcccctcgaggccagggccacactccggagttcccttgtactgagcagagtggacgaggccttctacctcctgtagcccccagctggcttgatttggctggtc

SEQ ID NO: 818 - DNA, 255 bp, Homo sapiens
atcagagtgcgccgtcgtcgccgccgccaccactgtcgccatgaacagtgtgggggaggcatgcacggacatgaagcgcgagtacgaccagtgcttcaatcgctggttcgccgagaaatttctcaagggggacagctccggggacccgtgcaccgacctcttcaagcgctaccagcagtgtgttcagaaagcaataaaggagaaagagattcctattgaaggactggagttcatgggccatggcaaagaaaagcc

SEQ ID NO: 819 - DNA, 255 bp, Homo sapiens
ggcgttacgcgcgggcgcactgcgggggccaaggaaggaagaaatgtggtcgcggttggtgtggctgggccttcgggcccctctgggcgggcgccagggcttcacctccaaggcggatcctcagggcagtggccggatcacggctgcggtgatcgagcacctggagcgtctagcgcttgtggacttcggcagccgcgaggcagtggcgcgactggagaaagctatcgccttcgccgaccggctacgcgccgtgga

SEQ ID NO: 820 - DNA, 255 bp, Homo sapiens
ggtttgcacgccggaccggagagcgcggaggcagccatggtgcggttcaagcacaggtacctgctctgcgaactggtgtctgacgacccccgctgccgcctaagcctcgatgaccgagttctgagcagcctcgtacgggacacgatcgccagggtgcacggaactttcggcgcagccgcctgctccatcggcttcgcgggtacaataagaacatgtcagaagttcctaattcagtacaacaggagacagctgttg

SEQ ID NO: 821 - DNA, 255 bp, Homo sapiens
tcggcgggtgtgatcgagtggcctcgcctcatcgcctagcgcccccctcagtcgccgccgcctccgcccgccggccatgtcccccggccgccgccgccgccgcccgagcgcggcgctcccgcggccccgcgcgcagtgagcgcgggcccgtcttgccgttcgcccgccccagggcccccttgttctccgcgccgccgccgccgccatgttgggtttggagctgcagcggagccgccgccgccgccgcgggtgagg

SEQ ID NO: 822 - DNA, 255 bp, Homo sapiens
cgtggccctgtggcagccgagccatggtttctaaactgagccagctgcagacggagctcctggcggccctgctcgagtcagggctgagcaaagaggcactgatccaggcactgggtgagccggggccctacctcctggctggagaaggccccctggacaagggggagtcctgcggcggcggtcgaggggagctggctgagctgcccaatgggctgggggagactcggggctccgaggacgagacggacgacgatg

SEQ ID NO: 823 - DNA, 255 bp, Homo sapiens
gcggatgtctgtttcctgggatattgtgagggcgggcggagatgtagacccggtagtgttgtgccttgtggtgacaactggcggcagcgcgccgcgggcccgagacttagtctcgggccgccatggccagcgtccacgagagcctctacttcaatcccatgatgaccaatggggttgtgcacgccaatgtgttcggcatcaaggactgggtgacgccgtacaagatcgcggtgctggtgctgctgaacgagatga

SEQ ID NO: 824 - DNA, 255 bp, Homo sapiens
gtgtgtccacatctttgagtgccgggagtttaaaagttaggcagtccttataggtatggaagccgagctaatttccttctgagccccccaaatgcctcctccacatggcgggtccgcaaatggggggatctgcagaggatcaccccccacgaaaaagacatgcagcagaaaagcaaaaaaagaaaacagttatatatacaaaatgctttgaatttgagtcggccacacagcgcccgattgaccgccagcgatacg

SEQ ID NO: 825 - DNA, 255 bp, Homo sapiens
agtccagcactaaaggatccccactaagggctgttcacctgccccagggactcagaacacacatgactctccccacttgagctcaggatcccggcattacacggggcgcgctgagccccagatgtccctaacccctttccagcaccctccagccttgcagaagcagccaccatgccagtctctaagtgcccaaaaaagtcggagtccctgtggaaggggtgggaccggaaggcccagaggaacggcctgcggagc

SEQ ID NO: 826 - DNA, 255 bp, Homo sapiens
agttgcgcgcgtggctctggctgcgcaggaacagctggtgcctccgagggcggtcggcgagcgcgcgggcgtggggcgctggggggccggtcgggcagcgctgcgggagcagccgccggcaccgccgccttgcaccatcgcatcatgtccgggcagctggagcgttgcgagcgcgaatggcacgagctggagggagaatttcaagaactgcaggagacgcacaggatctacaagcagaagctggaggagctggct

SEQ ID NO: 827 - DNA, 255 bp, Homo sapiens
ggagctgagctggggaagggagaccagggttcaccacgttagcattcgcattcctgggaggatgcagccctcgcctggacctgggcgatagacgccttcttctgtttttatttttggaggggagcgccctgtaattgtcctgaacacatgcttcccccccttcctccagccacccgcggaggagagagtcccccttttttgcatttatcttttccttcccctttctttattaaaggtccgggagtggcggcggcc

SEQ ID NO: 828 - DNA, 255 bp, Homo sapiens
gagctcggggaccacgcggaggttgtaattggtctctagaccacacctagttgttgagtgccgctgcttgaaaatctcagttctgccgagatcgcagaatacacacaagctacctttgggcaccagagcagacagaaccgcggagcttcagggtggaagattcgtggaaactttgccaaggccaggacctcgtgtgttcccgtccgcccctctgggacggcgccagcccggcaggccgccgaccgtcctggggct

SEQ ID NO: 829 - DNA, 255 bp, Homo sapiens
gtgcgctgccgtaccggtcacgtggacgtttggtcacgtgactgcgtccgtggtcctcccgtaggaaccggcggactcggttggcgttgtggggcagggggtggtggagcaagatggcggctcatctgtcctacggccgagtgaacctaaacgtgttgcgcgaggcggtgcgtcgcgagctgcgcgagttcctggacaagtgcgcaggaagcaaggcaatagtttgggatgaatacctaactggaccctttggcc

SEQ ID NO: 830 - DNA, 255 bp, Homo sapiens
gctgctgctgcagtgggacaggtggcggcgaccggcggcgtccgaggagatttaatccagagactgacttcactatagaacccacagttgtatcaatggttggggaaagatagtggcaacaggcaaaggagaaacagctctgacatacaaagaaaatgagtatgctaaagccaagtgggcttaaggcccccaccaagatcctgaagcctggaagcacagctctgaagacacctacggctgttgtagctccagtag

SEQ ID NO: 831 - DNA, 255 bp, Homo sapiens
cctcctttgacagggacatcagtggagccttctcagacccacaggggtccttggtgaattttgtcatggttatttaaggaaccttgcctagaagtcccaacttgcagttccccatcgacgggaaggcttggactccaagatgattataaaggaatatcggattcctctgccaatgaccgtggaggagtaccgcatcgcccagctgtacatgatacagaagaagagccgtaacgagacatatggcgaaggcagcgg

SEQ ID NO: 832 - DNA, 255 bp, Homo sapiens
aagtgacgcacgaggtgctgtgactcgtgccagccccctaatctgcggaagtggagtgcggggagtgcgccggaagaggggtacggaagtgcgccggaagtggggtgcggaggtgtgcagcgcgctgtcagactggctcgcaggcggcgcggccggcggacccgttcgagacagcgcgggcggctcgggtcccctggggctccgcagcaggaggacgccatggacgacaaggagttaattgaatactttaagtct

SEQ ID NO: 833 - DNA, 255 bp, Homo sapiens
atgggccacgggcccccaccgccgcccgccgggaggaccgagcctaagagggcagccgcctgaaggaacgcgacggcggcgcccgcagtatttttcagtgctgtacaagcgtcttgaattactctggtagcttttccagaaagacccatgacttcaccacatttctcgagttacgatgaaggtcctctggatgtcagcatggcagccacaaacctggagaaccagctgcacagcgcacagaagaacctcctgttc

SEQ ID NO: 834 - DNA, 255 bp, Homo sapiens
gccggcgccctaggaggcggcggcgggaggatcgcgtcccgacccgaggccgggcctgctgcgcgcccccagcccgatcggcaccgccacttgcctgagcgccccggcggcccgagcgcgccccaagcccgggcgccaccgctgccacctccgcgaggtctccctgagtctttgaggacacagcctcgctggaggcagtttctggtgccagtgacggggtggcccgtgagctgatgacgaggactggcttttaat

SEQ ID NO: 835 - DNA, 255 bp, Homo sapiens
tctcacggccggagttggtggtctgggaacccacgtgggctgggtttcggattgctctgctggtccggccgctggagcgcccaccctggcctagtcgccatggggaagctgcgccggcgctacaacatcaaggggcgccagcaggcgggccccggaccctcgaagggcccccccgagccgccccccgtgcagctggaactggaggacaaggacacgttgaagggagttgatgcaagcaacgcgctcgttctaccg

SEQ ID NO: 836 - DNA, 255 bp, Homo sapiens
gcagcgcgccacgcccgagtcccaggcgtgcggctggccatggcgctgttctacgtcgcgcggtacccgggccccgatgcggcagctgcggcggggccggagggcgcggaggccggggcgcacggcagggcccgcgcgctgctcgagcggctgcagagccgggcccgcgaacggcagcagcagcgggagcccgcgcagaccgaggcggctgcatcgaccgagccggcgaccaggaggcgacggcggccccggcgg

SEQ ID NO: 837 - DNA, 255 bp, Homo sapiens
ggtgcgccgcgcgcgcctaccacacacttttccccggtccctgccggccacctcccccgccgggcgccggcgccaattggagcgcctcggggggcgggggaggggcggagcgcgcctcttgatggacggcggcatttccggctctcgcgagtctgggtgggagcgcgccaaatttctcccctgaagcagaggtggtagccaacggctccatgtctctgaggagcggcgggcggcggcgcgcggacccaggcgcgg

SEQ ID NO: 838 - DNA, 255 bp, Homo sapiens
ggcctgggcgcgtccctgcagcgtggcgggacggccccgttccagtcacccccgcctcgctgcggtggcctcgggcctgggcgcccgccttcagctgcggcggagctggctctgtaaatgccggtgcccgcgagccctcctgaatgcttgtctgcgcccgacgagcgcggcctgtcccgaagctgtccactgccaccactcgggcagtgcttgctttagcctggccctttgcagctgaaaggcgtgacatggtgt

SEQ ID NO: 839 - DNA, 255 bp, Homo sapiens
agaaccgggtgaggcttatccccgctgtctttccagtccagggccgccgagagtgggggtggctgggagcagcgcagcctccggaggaggaggcggaggcggaggcgactagggaggcggagatgggaccaagaatcgccttcagccctgtctggtgcatccttggcagaaagtgaggaggaaaacacccccattgttctttggcatggacacaagttcagtgggaggattagaattgactgatcagactcctgt

SEQ ID NO: 840 - DNA, 255 bp, Homo sapiens
gtgtgctgccgcggcgcgggaggagagtgtgcgttgcgctttctcccgcgatcgccctgccggtcgctagctccgagggcgcgcactggatcccaggctcctccgagagtgcggcgacctcggggctccgccggcaccggaggtggctctgagggcagggacgtgttggacacgctgactttgtaggctccgccaagaggcgccgcaggagcccgtggccacccaggagcccgatgtgcaaggcaggtgtgagtg

SEQ ID NO: 841 - DNA, 255 bp, Homo sapiens
acgtaccagggctcattgcgtgacggttacacttccggcgggctacgtgcgcgcggcgagcgccgggcgtacttttgcgtggttgctccaccccctcagccttgccttcgccgccgttggggctggaagttcccgccaggtccgtgccgggcgagagagatgctgcccggcccgcctcggctttgaggcgagagaagtgtcccagacccatttcgccttgctgacggcgtcgagccctggccagacatgtccaca

SEQ ID NO: 842 - DNA, 255 bp, Homo sapiens
ctccccgggcggctccggctcccgcagcgggacagacccacccgcccaggcttttatccggcaccggcagcgtcttcctttcctcccccgtctatggtggtggcggcggcggctcctcgggcggcggcggaagacgaggctgcggcgttgccatgaacagtggcggcggcctcccgcccccctcggccgccgcctccccttcctcctcctcgctggcggcggcggtggcggtggtggccccgccgggggtcgggg

SEQ ID NO: 843 - DNA, 255 bp, Homo sapiens
tcctattatctgggcatttggaggtgaaggggtcacagctctggcaaagatggggttgaaagggcccggactccagggaggggcagctctgcatggcctgattcctgcaccccacctttgccccctcacacctcctctcatctcccgtttttgaagaggaggaccctgtcacatctggacaattctgcaagaactctgtagaactgacttcactgtgaaccaggctccagaagtcaacagaaacaaaaatgctca

SEQ ID NO: 844 - DNA, 255 bp, Homo sapiens
ggcgcagcgaagtagcctccggcggtggcaactacggcggcggcgccggggcgatgctgtgggtctcgttgggcgccggtgtcctggcctcttcctcagatgaaaagattctgaagaatagagatcttgaacatagcatggtgccagacacataacagaacgaagaacaaactaaattcatctcaaaatgattataaatcatcaagaaggagtagcctgccacctgaactactcataggaaatgacattagagga

SEQ ID NO: 845 - DNA, 255 bp, Homo sapiens
cgcgcagcatgcccgccagcgccccgccgcgccgcccgcggccgccgccgccgtcgctgtcgctgctgctggtgctgctgggcctgggcggccgccgcctgcgtgcggagccgggcgacggcgcgcagacctgggcccgtttctcgcggcctcctgcccccgaggccgcgggcctcttccagggcaccttccccgacggcttcctctgggccgtgggcagcgccgcctaccagaccgagggcggctggcagcagc

SEQ ID NO: 846 - DNA, 255 bp, Homo sapiens
agattgcagagggagacgtggacgtgagtggagcggggcggtccccagcacactagaggaagtcgtgctacccccgcggagttgtcgtgtgttctggattcattccggcaccaccatgtcgaaggtttcctttaagatcacgctgacgtcggacccacggctgccgtacaaagtactcagtgttcctgaaagtacacctttcacagcagtcttaaagtttgcagcagaagaatttaaagttcctgctgcaacaag

SEQ ID NO: 847 - DNA, 255 bp, Homo sapiens
aaagggcgctccgcgcatgcgcacaggatccggctcgggaggcggaccctggctgccatcttgcagtgcgcgggaaccgccgccgccgccgctggccaaaaagcggagcccaggggaagcgtgtcctgctcagaccgccttccttctccattgccacccgtgccgaacagccaggctgcccaattgcaactgtagaccaatgaactaatccatcgcccgcagcccgactctcagcagcggttcgtcccggtgccc

SEQ ID NO: 848 - DNA, 255 bp, Homo sapiens
ctcccaggggatgtgcgagcagtctccgccctcgcgcgggagctgggaggctgcgagatccctaccgcagtagccgcctctgccgccgcggagcttcccgaacctcttcagccgcccggagccgctcccggagcccggccgtagaggctgcaatcgcagccgggagcccgcagcccgcgccccgagcccgccgccgcccttcgagggcgccccaggccgcgccatggtgaaggtgacgttcaactccgctctggc

SEQ ID NO: 849 - DNA, 255 bp, Homo sapiens
ctcccggctccgtagtaagcatggcggcggcggcgttcgtggtccctcgggtgaaacagaaagcgggagctacgcggagagggagcgaagagcggggctgaggcggcggcgtcactgccaggaaacaaccccaacagtcagcgcgccggcggccgcggcggccctgagagctgactctgcagctgaggtagagagacaacgatcaggaaccctaagaagaggcgccagaggagccgccttctgcctcagaacggc

SEQ ID NO: 850 - DNA, 255 bp, Homo sapiens
atctggctgcgcctagtgggccgttgccttacagttgctgagaggaggcgagaggcgggggcgctagggccgagatcatgtctgactgggagaggtttccttggcagcagaggacgctaggtttgggatgaaagaagctgggcagatgcaaaatctggagagcgcgagggccgggcggtcagtcagcacccagactggcagcatgaccggtcagataccaaggctttctaaagtcaaccttttcactctgctcag

SEQ ID NO: 851 - DNA, 255 bp, Homo sapiens
cacccaagtctgagttgctaaaaaatggagctgtcactgggccttgctctgccaggacctgcagagccggggacctctctgtggcaagcccagcaagatgactgctctgaggcgccctagggctgagggaggggccgtgacaccagccccgccccccagccacctgggaaaaggaagcacaaaaaggagaagcagcaacggctgctctgcttccttcccatctcgctcttgggtcatgcctggccagcagaaagc

SEQ ID NO: 852 - DNA, 255 bp, Homo sapiens
aacaggtaatgtttaacgtgccagtcacaaagatcacagaaacagtgtatgcccgggcataagatagcacgactgtgtatgctctggaggactgaaaggctgtacaagccctatgtattttttttcaaatatacatatgcatgggtcttgctgctgcctcttttgctgactgtaattggactttgaagcttcgaagttatatcataaaaatttgtaacctttgtctgagagagagctcagctaagcaatcacttt

SEQ ID NO: 853 - DNA, 255 bp, Homo sapiens
agagccactgaggcctgagcgagagccgacggcgggcgggcgcagctgctgccggagcgccggcgcgtgctggtgggccacacacctttcctcctcttcactcgcgagccctcggacatggtggcccccggctccgtgaccagccggctgggctcggtattccccttcctgctagtcctggtggatctgcagtacgaaggtgctgaatgtggagtaaatgcagatgttgagaaacatcttgaattgggcaagaaa

SEQ ID NO: 854 - DNA, 255 bp, Homo sapiens
gtgcctgcgaccgttctcactgagcatgtgcagacggcggtgcgcatgctctgttgcggtccgcttcggtttctgttgcgggacccggggtgtctcctagcgcaaccggaactagccttctgggggccggcttcctttatctctggcggccttgtagtcgtctccgagactccccacccctccttccctcttgaccccctaggtttgattgccctttccccgaaacaactatcatgagcgcgaggctgccggtgt

SEQ ID NO: 855 - DNA, 255 bp, Homo sapiens
aggcaaagggcggggcgcgcgcgtcgggaagatggcgctacgtctgctgcggagggcggcgcgcggagctgcggcggcggcgctgctgaggctgaaagcgtctctagcagctgatatccccagacttggatatagttcctcatcccatcacaagtacatcccccggagggcagtgctttatgtacctggaaatgatgaaaagaaaataaagaagattccatccctgaatgtagattgtgcagtgctcgactgtga

SEQ ID NO: 856 - DNA, 255 bp, Homo sapiens
ggcatcgggtttctggctcgtgatttgccggagctcctgcgctccccttctccaccccctccggctgtgtgagaggtcagcagaggggcggtctgcggggacaacaatggcggggttctgggtcgggacagcaccgctggtcgctgccggacggcgtgggcggtggccgccgcagcagctgatgctgagcgcggcgctgcggaccctgaagcatgttctgtactattcaagacagtgcttaatggtgtcccgtaa

SEQ ID NO: 857 - DNA, 255 bp, Homo sapiens
gccagtgagcccccgcgacggtggcccggacggaaaagatacctcggcggcgtgggcccggctccctgctccaggacctagggatcttggccttccaccctcctccgagcaccaggactccctccagttccgtacccgaggcctccgtggtgaagaggtgccggacccgatgagctcgggagtccaccatcgctctgcaagccgcagttaaacgagaagattcatcaccgctttgatggctgcctcacaaacttc

SEQ ID NO: 858 - DNA, 255 bp, Homo sapiens
tgcggggagccgagccgccggcgctcgacgcgcgcgctctcgcgagacccgcgggatcacgtgacgcccgggcgcggcgcagctcacgtgacaagcgctgccggccgcggtgtcttcttcgtgccggcgtcgcagtggccgggcctcttgcgtctggtaacgccgctgtctctaacgccagcccttggcgcccgcgccccgccaccgcagcgcccggcagtccgcggcccaaccgccgcccgcgcccccgctccc

SEQ ID NO: 859 - DNA, 255 bp, Homo sapiens
ttaaagggggcagtgactgcggctgggcgggagtccgggtcggcttggctgagcgggggcggtgctgggcagggcggcggccgctccctcccggactcccggcctcccggcctccctggtcccgcctgggaagggatgcaaggaagccctccggcgctgcgctccgaggcgggagacagcgtccccctccgcccctcgggtcctggcgcctcagagcccggcccaggccgcggaacggtgatgctcgggccggac

SEQ ID NO: 860 - DNA, 255 bp, Homo sapiens
agctctcgcgaggtttcgtcgggggctggcggctgcggctcggcggagagtgcggcatgcgctcggaaaaggagggggccggaggccttcgggcggccgttgccgcgcggggcccgagcgggagggagaagctgtcggccctagaagtgcagttccaccgcgactcgcagcagcaggaggctgagacgccgccaacttcgtcctccggttgcgggggcggtgcgggcaaacctcgcgaggagaagaggacggccc

SEQ ID NO: 861 - DNA, 255 bp, Homo sapiens
cgcgaaaagccgggactggacctcgcggagttgtgcttgtcgccgaagcggggtgggcttgttcgttccgcgcagccgcagccagaaccgggtgacgcttatccccgctgtctttccagtccagggccgctgagagtgggggtggctgggagcagcgcagcctccggaggaggaggcggaggccgaggaccaggaatcaccttcaagcctatgtcgtgaggctttggcagaaattaagaaggaaatatctccatt

SEQ ID NO: 862 - DNA, 255 bp, Homo sapiens
tggggtgggggcggggcctggctgggcgccgggacgggaggagtcccggcggcgcctcggacttttgctcccacaagtcctgcctcggaggcgggggagctggaccagcagccgcctggagcgtccgagtcaccgtcgccggggctcccgcgctccccagaacggtgggacgcggggctcggcagccgccagcggaacatggcgccctggacgctgtggcgctgctgccagcgcgtcgtgggctgggtgccggtg

SEQ ID NO: 863 - DNA, 255 bp, Homo sapiens
cgcccgcccagccccgggggcagggagagcctagattacggaagtaccgcgagcaaggagcgcggaatcggggagcgtccggagctagctggatcctctaggcaggatggtgatgggaatctttgcaaattgtatcttctgtttgaaagtgaagtacttacctcagcagcagaagaaaaagctacaaactgacattaaggaaaatggcggaaagttttccttttcgttaaatcctcagtgcacacatataatctt

SEQ ID NO: 864 - DNA, 255 bp, Homo sapiens; identical to SEQ ID NO: 841

SEQ ID NO: 865 - DNA, 255 bp, Homo sapiens
tgagtaaatgccgcagattctggaaagttctgatcagtgcgatacataaggctgaggaagtgggacctccccttttgggtcggtagttcagcgccggcgccggtgtgcgagccgcggcagagtgaggcaggcaacccgaggtgcggagcgacctgcggaggctgagccccgctttctcccagggtttcttatcagccagccgccgctgtccccgggggagtaggaggctcctgacaggccgcggctgtctgtgtg

SEQ ID NO: 866 - DNA, 255 bp, Homo sapiens
agtacccctatctgaaatgcttgagaccagaagtgttttggagttcagattttcttttggattttggaatatttgcagaatacctactgattgagcatatctaacctggaaatccaaagtgctccggtgaacattttctttgagcatcatgtcaatcaatgctcaaaaagttcaggattttggagcttcttggattatgggtgctcaacctgtataggaaacgtggagatggagcatgaatcagttgtatttgat

SEQ ID NO: 867 - DNA, 255 bp, Homo sapiens
agaaacacttggtttcatgtatgactcataagctgaagcacagacaccacttccccaatctacaggagccattttaacagctaaaacttgtcggattgctttttattttcaagctcaaaagacgatagagaaagaatacttgaaggccaagaagcttgagagaagaaaaatttcagaaaaattgtctcaatttgactagaatatcaatgaaccaggaaaactgaagcaccttccctaaagaaaacttgggtatac

SEQ ID NO: 868 - DNA, 255 bp, Homo sapiens
caggtgatttttggtggggcggggacatgaaaaaaaagttaaaatgtccttataaagacaaaatctttttctttcctggctgatgatttgtcattctagtcacttcctgccttgtgaccacacacccaggcttgacaaagctgttctgcagatcagaaagaaggggttcctggtcatacaccagtactaccaaggacagcttttttcctgcaagatctgttacctaaagcaataaaaaatggccagaggatcagt

SEQ ID NO: 869 - DNA, 255 bp, Homo sapiens
gccccgcgcctgaggggcagtaaaagtcgccaggtccggctccatttctggcacaaaacttgcagcaccgaggggttgtggagagcccttgcaggggaagagggcagggtcatcccgagaaccaacgggcacgtatagcccggcgaacgcccaagccggtcaccgcccccggtcacgtgtcgccagcctccgcggccgcgcgccgctctcagcaccgttcccgccccacccggcccggcagtcggcccgcgcctc

SEQ ID NO: 870 - DNA, 255 bp, Homo sapiens
cacgaggccgtctccccggcccagcccggccgctcgccctgtccggtctctccccggccccttgattctccgcgtcttcctcgcaggccagcctaagctcagcctgcattgcgccctcccggcctagggtgtcgctgtaccggcctccgagctccacatagacaagtccggacctcgggcgggggcaggagacggagctgagcggcggggggcagtgtcgcctcggtctagggacggcggcggagtcggtggtcc

SEQ ID NO: 871 - DNA, 255 bp, Homo sapiens
ggagctttgctgaaactgcacaaaaaatcgagccggggggttccctggtccccggcgatggggcggggagcgctgcgccgggggagggggcgggcgcggcggcgcgggccccgccgaggggggacacctggctgaggcacagctgccgccgtgcctttccgcgcgagcccagagctccgatccctgcgcgggctcgagagctcgccccgaacgggggtcttcctcctccgccgttgacaggttttgacctgtagc

SEQ ID NO: 872 - DNA, 255 bp, Homo sapiens
gtgactgaggacccaacagtgtgctccttgcttggaggctagtgatgagctcctaatttcactgtggactgcccagatttctacaagacaggcttctggagacgctgtggattctctcctgagtgactaggggctggcaggaagggcgggcgcttggtgctgcatctcaatccctgtggccccaggagcagctgcggcaggaacatgtatggatttatcaacacctgtctgcaatctcttgtgatagagaaattt

SEQ ID NO: 873 - DNA, 255 bp, Homo sapiens
agtagaacggcgaggcggtgtatcacgtggctcggggacgtgtcaggggcggagcctccgcagcccctgcccgagttaaaaccggagtgtgagagagaaaagcgcttcagtagcgagaggggctgagaaagtggtgacaccgccggggtgcggagggagtccctgaaacttctcccaacagccccagggccaatcttccctcagcccactcccctcttcgccagctcccaggtccccactcctgtaccgggggtg

SEQ ID NO: 874 - DNA, 255 bp, Homo sapiens
gttcgcagccgccgccgcgccgccgtcgctctccaacgccagcgccgcctctcgctcgccgagctccagccgaaggagaaggggggtaagtaaggaggtctctgtaccatggctcgtacaaagcagactgcccgcaaatcgaccggtggtaaagcacccaggaagcaactggctacaaaagccgctcgcaagagtgcgccctctactggaggggtgaagaaacctcatcgttacaggcctggtactgtggcgctc

SEQ ID NO: 875 - DNA, 255 bp, Homo sapiens
gcggccgcggggaccctcggcgtggtcctctgaccctgcaaacccgcgacggaggaaggggaggtcctgcccgaggcgccagcccaaggaggaggatgcccatttaacccgccctcgcctgccgggcgcttgcctcggtgcccgccgccggagcctccgagccgcgcccgtggaagtgctgcatggggcagggctgctgaagcgcggagttcggggtcgcgccgctcccaggcaggcgcgggagcccggtgcggc

SEQ ID NO: 876 - DNA, 255 bp, Homo sapiens
aaacagccttttgggacctgtccccggacgaggactgcccccctccctcgggcaactactactgatgctgtccaggcatcgcccaaggggaaaggttgcagcggggtcggaaggcgcgggaggagtctggcggtgattgatgggaagggatgaatgaataaaagtacttgtctgatggcagcagagaccccgagcaaacggtggaggctacactgtctggcattctcgcagcgtttcgtcagagccggacccgcc

SEQ ID NO: 877 - DNA, 255 bp, Homo sapiens
cgcgccggagcgggacacgcatgcgccggtctggacccggcacccagtaacggactcgagctcctcccaccggaagtgggcagccgcgcagcgggaagagccggccgaagcgtggcggccacagactgtgggtaccgggtccgagggactcgcgcttttctctccgtgccatggcgccagcgaaagccacgaacgtggtgcggctgctactaggctccacagcgctgtggctttcgcagctcggctccgggacgg

SEQ ID NO: 878 - DNA, 255 bp, Homo sapiens
atgctcagtcacagggtgacagagaaaaaaaaagtcaccaccataaaaggaggtctgcacagcctctcttaaaacaacatgccacagttaaaacttacttcagtttggacaactactcacagctactacacagagacccgaacgagtcactgatatacacctggaccaccaccaatggatatacaaatggcaaacaattttactccgccctctgcaactcctcagggaaatgactgtgacctctatgcacatcac

SEQ ID NO: 879 - DNA, 255 bp, Homo sapiens
ccacagcgctgtagactgcgccgcattagaagcctggcctcctgatgctgtgctcttcatctagacccaagccccaggtcgtgggacgatttctcccgtttttgactccctggaactgtattgcctgctttacctgcgtacatgttgattctttctcatggcaaccccgcaggaaaccatcaagatctcattttacagctgggattctctggttcacagaggtaacggagcttgcccgaggccagttaaacgaga

SEQ ID NO: 880 - DNA, 255 bp, Homo sapiens
gcgcgctccgctcggcagcctgtgggacgcgaccgcggcgctagtctcgttcctttgtgctgcggcggcggcttctcgagtcctccccgacgcgtcctctaggccagcgagccccgcgctctccggtgacggaccatgtcggcggcgggagcgggcgcgggcgtagaggcgggcttctccagcgaggagctgctctcgctccgtttcccgctgcaccgcgcctgccgcgacggggacctggccacgctctgctcg

SEQ ID NO: 881 - DNA, 255 bp, Homo sapiens
tggcggtcttgcaggcgggcggaccctcggccgcgctcggggctccggcgccgccgctcctcctgctcggcctgagctgcccgggctcggcgcgcgcttggggcgaggctcggcgggcgcggacgcgcagcatggcggtggaggacgaggggctccgggtcttccagagcgtgaagatcaagatcggtgaagccaaaaaccttccctcttacccggggccgagcaagatgagggattgctactgcacggtgaacc

SEQ ID NO: 882 - DNA, 255 bp, Homo sapiens
gctgcccctgaaccccagaacaaccagctggatcagttctcacaggagctacagcgcggagactgggaaacatggttccaaaactgttcacttcccaaatttgtctgcttcttctgttggggcttctggctgtggagggctcactccatgtcaaacctccacagtttacctgggctcaatggtttgaaacccagcacatcaatatgacctcccagcaatgcaccaatgcaatgcaggtcattaacaattatcaac

SEQ ID NO: 883 - DNA, 255 bp, Homo sapiens
atgtcacatctggtggaccctacatcaggagacttgccagttagagacatagatgctatacctctggtgctaccagcctcaaaaggtaagaatatgaaaactcaaccacccttgagcaggatgaaccgggaggaattggaggacagtttctttcgacttcgcgaagatcacatgttggtgaaggagctttcttggaagcaacaggatgagatcaaaaggctgaggaccaccttgctgcggttgaccgctgctggc

SEQ ID NO: 884 - DNA, 255 bp, Homo sapiens
ggccctccctggaggagaactgaaacttagggtggggactgtagaaaggggcggagagatcagccgcccagccaggagttaagctgaggtcgtctgagccctgcgacagcctggacagcaactcaggatggcatcaggcagggcacgctgcacccgaaaactccggaactgggtggtggagcaagtggagagtgggcagtttcccggagtgtgctgggatgatacagctaagaccatgttccggattccctggaa

SEQ ID NO: 885 - DNA, 255 bp, Homo sapiens
aaaaagaactgcttctctttctttccccctccaagttcctagtggagggctgagtccagcatcccagactcgtgtgactatataggcaagcatttggggacctacttcactttgataccctagccttcagcagctcaaggtgttggcctttggataggaggcttccaagtagtaaagctccctgctctcagcaagcccaacaccatggggaagggagatgtcttagaggcagcaccaaccaccacagcctaccat

SEQ ID NO: 886 - DNA, 255 bp, Homo sapiens
cgacgtcgaaggtccgtccgcagttaaggaagcttttgcagccggacaggtcgcgaagcacacatggggcagggtccgcgctctccacacaaggtggggcgccggttcccagctggtggcaaacgggggcgcggggccaaggggtcggggcgccccttaccaggccgtaagcggcaaccctggccgcctccggatgggcgctcggagccggctccagattcgcacccgcacctgagcccggaagctctgggatat

SEQ ID NO: 887 - DNA, 255 bp, Homo sapiens
cgggctttgcttccggggcggtaagggcagccacgtcatccccccgctccgctccccagccgggcagtggctcgtgggagccaagatggcggcggcggcggcagcgacagcagcagcagcagccagtattcgggaaaggcagacagtggctttgaagcgtatgttgaatttcaatgtgcctcatattaaaaacagcacaggagaaccagtatggaaggtactcatttatgacagatttggccaagatataatctc

SEQ ID NO: 888 - DNA, 255 bp, Homo sapiens
gagttttgtgcgaaggaaaccgatggggatcggaaccgtagcggttgagctgctgctgctacggatatctgacagaagccttcggtggttgtcggcctaatgagcggacggcaaagaacgctttttcagacgtggggctcaagtatctcccgatcatctgggactccgggttgcagctccggaactgagcgacctcagagccctggcagctccaaggcgcctttgccagcagcagcggaggctcagctggagtcg

SEQ ID NO: 889 - DNA, 255 bp, Homo sapiens
gggacacggcgcgggatggacgcgcaggactgccaggcggccgcatcgcccgagccgcccgggcccccagcccgtagctgcgtggccgcctggtgggacatggtcgaccgcaacctgcgatattttccacactcctgttcaatgctcggaagaaaaattgctgctctgtatgacagctttactagtaaatccttaaaagaacacgttttccttcctctgatagacatgctaatttattttaattttttcaaagcc

SEQ ID NO: 890 - DNA, 255 bp, Homo sapiens
cgcccgagccgcgcgcggagctgccgggggctccttagcacccgggcgccggggccctcgcccttccgcagccttcactccagccctctgctcccgcacgccatgaagtcgccgttctaccgctgccagaacaccacctctgtggaaaaaggcaactcggcggtgatgggcggggtgctcttcagcaccggcctcctgggcaacctgctggccctggggctgctggcgcgctcggggctggggtggtgctcgcgg

SEQ ID NO: 891 - DNA, 255 bp, Homo sapiens
ggatccgtggcccctcccccggccaaccgtcgattgggccggcgcgtgacgtcactccgttttagccaaacaaatgggtttcggggcgagcgttgggcgccgccgcgccgcgctgggtgctcggtccgactcagcggtggggagtgagccaggcctcccgccaccgctgctgccgccaccactgcgtcgggctggtgcagccccgggccaggccgcggccggggcaggagcgcaggggctttgttatgcacctaa

SEQ ID NO: 892 - DNA, 255 bp, Homo sapiens
ggctcgacccggaagccgccgtggccgccgcacaagctgcgctcgtctctcggctggggagctccgtgtcgcaccgggttcttgggctggccgtgtccttctccctcggtcgccactggcccatgagtccccatggcgacggcaggggccaggcccaggggcgggcagtccgagtggggctgcggcgctccgggggcatccgcggcggcgtggcggtgttcgccgccgtggccgcagtgttcaccttcaccctgc

SEQ ID NO: 893 - DNA, 255 bp, Homo sapiens
gtcgccgacgcccgagcgccggagccccggccccgccccgcgagcgccgagacttgttggccgcggagactgcgaccctcttctctcagtctgccttactaccatgccgctctacgagggcctggggagcggcggggagaagacggcggtcgtgatcgacctgggagaggcctttaccaagtgtggatttgctggagaaactggtccaagatgtataattcctagtgtgataaaaagagctgggatgcctaagcc

SEQ ID NO: 894 - DNA, 255 bp, Homo sapiens
caataggagttcgtgtagaagcgagtctgctcaacagcttgttatttggtggattgtggcagtaaatcggggcgagtggggaacccggcgcaggaactgcagccgcggctgggagtggtgctgcccggacgggggcccacggaggtcagaggggaggaggactctggagctgacagcgcgcacttcacccgcagttgttctagcgactgcgaagatagctcgctgagctggaaccccacagatcaccaacaaaaa

SEQ ID NO: 895 - DNA, 255 bp, Homo sapiens
ctaaacccggaagcgagggaggaacttcggagctgtcgcccgggttaccgggaggcggagccgccgagctcgctgtggcccggatgttcggtgcagctgccagatccgctgatctagtgcttctcgaaaaaaaccttcaggcggcccatggctgtcgatattcaaccagcatgccttggactttattgtgggaagaccctattatttaaaaatggctcaactgaaatatatggagaatgtggggtatgcccaaga

SEQ ID NO: 896 - DNA, 255 bp, Homo sapiens
gcgcgcgccggcctgggcaggcgagcgggcgcgctcccgccccctctcccctccccgcgcgcccgagcgcgcctccgcccttgcccgccccctgacgctgcctcagctcctcagtgcacagtgctgcctcgtctgaggggacaggaggatcaccctcttcgtcgcttcggccagtgtgtcgggctgggccctgacaagccacctgaggagaggctcggagccgggcccggaccccggcgattgccgcccgcttct

SEQ ID NO: 897 - DNA, 255 bp, Homo sapiens
gtttgccgctttccgagcgccaaggagcggagcgcgctcagctgcgcccagagccttcggccggacctgaaaaagcgagagggagagcgagcaaaaggcgcgatccagagagccaggcaagcggggcgccgacctcgggcggccccggcccgcgcccttgcccctcggccgggcggacgttcacttcttcaactgagatggacatgatataatctccattgagtcaaagaatggcatctagtcctgagcttccca

SEQ ID NO: 898 - DNA, 255 bp, Homo sapiens
ccctcggcgtgaccccctcgcccccgtcgcacacggcggggcggttcagcacccaggtgcgcaaggagggcctcacccctgcccgcggcctcccacgccctccttgggcctctcctttcgacccccttaccctctccctgggagactctaccagaccttcgaggctgcgtgtcccagtcagctaaaaaggaggccccgcccgcggcacctggtagctcctcgggcgctgcgggttcgacgcggcaacagctgctg

SEQ ID NO: 899 - DNA, 255 bp, Homo sapiens
agacaatccggaagtggatggaatgaagagatgccacttggcggccatggcagctgtagtatcggcgactccgggtcaaggcccggtcgagtgcagtaccatgggcagcaccgggtatagggcagagacagctttgtgtcaactttgctgctgaacccctaggacccatcgttagagacctgcaggactcctttcctcatcccaggctcggaggagagtttgctgggactggtgggctggtttcctgctctgggg

SEQ ID NO: 900 - DNA, 255 bp, Homo sapiens
attttgtggagcgccagagctgctaagtgcgtcagttgtggagtggcgtagacgagttaagtcctggtctgcgtggaggtcgacgactccgtcgcagactacggacctgtctgggtctcagccgccaaagaccccgtccggtaggtgagtggctcactttgagggcaagccttctcggatcgaggcttcttcatggccgctcagatcgtgagcggccggggctgctctctttgcggaggatggcgtctaatgagc

SEQ ID NO: 901 - DNA, 255 bp, Homo sapiens
gaggaggagctggagggggcgcggcttcctctcggtcgctccctggcgccgggcctctttctctgcctggcccagggctggcggccggcgggggtcgcggcggcggcagtgggggcgctggcgggccgcgggtggcgggggccgggccgcggctccgggtgttaggagacaagatggcggcggctctcagaaggccggtctcctcctctccgccgtcctccgccccgccgctcgccgcctcctcctctcgggtct

SEQ ID NO: 902 - DNA, 255 bp, Homo sapiens
acttgaatatctgctatatgctgggttctagagctgcaaaagagaacaagagtagtctttacctttaggattttccagggaactgggggagacagacagatacatacacatacaccccatcctcagtgtgtaggtgccatgacaaatcaaggcttttgatgcagatgctatgctttcacttctcatggtcgatactttttgaatcttaaagtctgattgttcagatatctagaaaaggagatgtctggctttgct

SEQ ID NO: 903 - DNA, 255 bp, Homo sapiens
gtttacacgctccggggcctgtaggcgccgcgagttccggctgtcgccgtcgccgccgcggctcctggaggtcggttgcgacgagtaacggcgccaggacgagccctgcgccttctttttcgatatgtacccgaattggggccggtatggcgggagcagccactatccgccgccaccggtcccaccgccgccgccagtggcgcttcctgaggcctcgccggggcccgggtactcgagctcgacgactcccgcggc

SEQ ID NO: 904 - DNA, 255 bp, Homo sapiens
caagagagagagagagcgtgcaagccccaaagcgagcgacatgtccctttggggagcagtccctctgcaccccagagtgaggaggacgcaggggtcagaggtggctacagggcaggcagaggaggcacctgtagggggtggtgggctggtggcccaggagaagtcaggaagggagcccagctggtgacaagagagcccagaggtgcctggggctgagtgtgagagcccggaagatttcagccatgcctcacagct

SEQ ID NO: 905 - DNA, 255 bp, Homo sapiens
gcgaggccccaagctggcccgggagaggactctgcgggcgaagtggctgcgcaaggagagaacttttcctgcacaaggaacgcctcgtggggagacccaaggcaggagcggtccggagccggctgcggcgtgtgcggccggccttgggacagcgatcgccgcgggtggcaacagagagccccaagcaaaagtgggagcaggagcttggaggtgagcacaggaagccccacttgaggcttttacgcagcctctagt

SEQ ID NO: 906 - DNA, 255 bp, Homo sapiens
cctgtcccctcagcagtgttggtttctcttcttgacttgatgcaggcacagatttatcaagctcctcagtcaacaaacacatcaccggaagaaatatggaaggaaaggaattttaaaaggaaataccaatctctgtgcaaacaaagccttgtatattcatgtttgcaccaatctactgtgagatttatgaagaaaaacaaattgcggacaactctctatgtacacttacaaatgcctcagttgatgcttgtgggc

SEQ ID NO: 907 - DNA, 255 bp, Homo sapiens
actgcgcgcatgcgcggcggccgccgaaggggcgggatccgaggcaagcgttggttctgtgcgcctcagagttggagcacacagctgtattaaaaaggcaaatcgaaggccgggcgcggtgactcacgcctgtcatcctagcactttgggaggccgaggcggctgaatcacttgaggttaggagtttgagatcagcccgggcaacatggtgaaaccccgtctctacaaaaatagaaaaattagccgagcgtgatg

SEQ ID NO: 908 - DNA, 255 bp, Homo sapiens
gagggtctgtggtcctctgatcaacataggctggtgggagtacaggactcgcctcctcagggttccctgtgctgccacttttcagccatggccacaagtgaacagagtatctgccaagcccgggcttccgtgatggtctacgatgacaccagtaagaaatgggtaccaatcaaacctggccagcagggattcagccggatcaacatctaccacaacactgccagcaacaccttcagagtcgttggagtcaagttg

SEQ ID NO: 909 - DNA, 255 bp, Homo sapiens
cccgcctcggccgccatggcggatgcggagccggaggctgggggcggcagcgaggatggcggcggcggcggcggcccggctcctccgggccagagcggcagcgtcgcacgtgtggccccgctgggccccgagcagctgcggcaggtcctggagcaggtgacgaaggcgcagccgccgccgccgccgccccccttcgtgctgcgggacgcggcgcggcggctgcgggacgcggcccaacaggccgccctgcagcgg

SEQ ID NO: 910 - DNA, 255 bp, Homo sapiens
ttgggggatgccgacgcctgggccttgaggatgctgcggaagctcaccatcgagcagatcaacgactggttcaccatcggcaagacggtgaccaatgtggagctgctgggcgcgccgcccgccttcccggcaggggcggccagggaggaggtgcagcgccaggacgtggcccccggcgctggtcccgcggcccaggctccggctctggcccaagctccggcccggccggccgctgcgttcgaaaggtcactcagc

SEQ ID NO: 911 - DNA, 255 bp, Homo sapiens
cgccccgcgcccgccaggagccaccgtccgagccttgcggagcgcggcagtgggcgccggctgcccgcagcccctgacccggccccggacggagcgccggccgcaccaccgccctctggccgttgcctcaccggctcggcaagatgtcggtgaaggagggcgcacagcgcaagtgggcagcgctgaaggagaagctggggccacaggattcggaccccacggaggccaacctggagagcgcggaccccgagctgt

SEQ ID NO: 912 - DNA, 255 bp, Homo sapiens
ccagctgcagagaggaggaggtgagctgcagagaagaggaggttggtgtggagcacaggcagcaccgagcctgccccgtgagctgagggcctgcagtctgcggctggaatcaggatagacaccaaggcaggacccccagagatgctgaagcctctttggaaagcagcagtggcccccacatggccatgctccatgccgccccgccgcccgtgggacagagaggctggcacgttgcaggtcctgggagcgctggct

SEQ ID NO: 913 - DNA, 255 bp, Homo sapiens
ctcaagccgcggtgtactccagcggccccctgtggcctctccatccgcggcggatctcagaggtgtggacaagcagcctactagggctagagatggacagcaggaaactgtccccccgggggaagaagctggagtcgcacctctcccaagagcacaggcggcccccactgggcctgatagcagcctggggccagcccagtatccagagcagcgttcagcagggactgcagactcaggactgggtgtgcgagccgc

SEQ ID NO: 914 - DNA, 255 bp, Homo sapiens
gtgattgatccgcgtcccctggagctggaggctcgggggaaagggccagcacggagcgggcgctcggttgctgcgcacaaaggctgaggctccaagagctgcagggcgtgtttggggtgcgcgcgaggttgtgtgcaaggtccggggcgcttggcaccggccacgcaagggtgtcagtctccacgcggacgggctgcgtagggactcgtagggacgggttccgggtgctgggcccggccggtctcctctgtccta

SEQ ID NO: 915 - DNA, 255 bp, Homo sapiens
atgggtaactggactgcagcggtgactgagtttgttctgctggggttttccctgagcagggaggtggagctgctgctcctggtgctcctgctgcccacgttcctgctgactcttctggggaacctgctcatcatctccactgtgctgtcctgctcccgcctccacacccccatgtacttcttcttgtgcaacctctctatcctggacatcctcttcacctcagtcatctctccaaaagtgttggccaacttagga

SEQ ID NO: 916 - DNA, 255 bp, Homo sapiens
agtgtgtggagaagccactctcccgaaaccagagggatggggccggctgtgcagtagaacggggatcgaaaagaggaaaacaagggcacgaagaccagcgagaaagaagaggacacctgggaaaggcggaagcagaagacggggaagggaaaagaaacccaaagcaggtggaaaccagatctagagcaacaccgtcaggttcacagtttgtttttctagaagagaagaaagtacctgaggattgctcttttttcc

SEQ ID NO: 917 - DNA, 255 bp, Homo sapiens
gaattgaatcaccttggcaacccgcggggcgtgcagcaacgccctttcctccggaagtgggtgtcagaacctccacgtgctgtccctccccctccccttttcggcccagtagcggcggctcagttgctgccatggagtcagccgggctagagcagctcctacgggagctgctgctaccggacaccgagcgcatccgtcgggccacggaacagctccagatcgttcttcgggcccccgccgctttgccggctctct

SEQ ID NO: 918 - DNA, 255 bp, Homo sapiens
ggccgcgctgccgatcgccgggaggacccccgcctcgccgaagacgggcggggcaagccgagcctcacggggtccccggagctgggccgggcctccagatggagaaggcgcaacggggagttcttgagtaagccagagcggtgtccagcgcggtgtagccgcagccgccgctgtcaggcgcagcaacgggcaaccccgtagaagtcggtcggcaggtcctctccaacccgccgctaccgcgccgctgtgggagag

SEQ ID NO: 919 - DNA, 255 bp, Homo sapiens
agagcgcagcggcgagcgtgactccgccatcaggtccccggctccctccccggacctagcccactccgctgcgccagcgccgcgggcagtgagttcggggatcaggggaacccggggctccctcgcaccaaccccaaatcctgccctcctggcgatgaggcttttctagggcacctctacaatccgggtttgagggaggaggaggaaaggactgagggatcccctcatcgccagctgggagcgggctgggaggcc

SEQ ID NO: 920 - DNA, 255 bp, Homo sapiens
gcgggactgtagaggcgcctataagggaagttgttcagtcaactcggaaaaagggtaacaacccggaaagtagactcaccgtcttggtctagagactgacccctgcacagacagaccccttcccctctctgcgaaaggaccaagccccagaagtcactccatctcctacggctcgcaatttccagaggccccctggcaccttccagcctgatgtcgtgcgtcaagttatggcccagcggtgcccccgcccccttg

SEQ ID NO: 921 - DNA, 255 bp, Homo sapiens
gggacgttcaggcggaagtggcgtcaggggcgctttagggactggacttgcagtgtaaacagagacgctgcaaattgcttgtggacggtgtaggccgctgcaggccaccatgaaccggcttccggatgactacgacccctacgcggttgaagagcctagcgacgaggagccggctttgagcagctctgaggatgaagtggatgtgcttttacatggaactcctgaccaaaaacgaaaactcatcagagaatgtct

SEQ ID NO: 922 - DNA, 255 bp, Homo sapiens
cttttcccatcgtgtagtcaagagtctgtgccagacttgaaggctttactttgttagccatgtgtttatgaacccccagcgctttccctagatcttttggctgataatctcaaacatggaggatgcttctgaatcttcacgaggggttgctccattaattaataatgtagttctcccaggctctccgctgtctcttcctgtatcagtgacaggctgtaaaagtcatcgagtagccaataaaaaggtagaagcgag

SEQ ID NO: 923 - DNA, 255 bp, Homo sapiens
agcccacagcagtccgtgccgccgtcccgcccgccagcgccccagcgaggaagcagcgcgcagcccgcggcccagcgcacccgcagcagcgcccgcagctcgtccgcgccatgttccaggcggccgagcgcccccaggagtgggccatggagggcccccgcgacgggctgaagaaggagcggctactggacgaccgccacgacagcggcctggactccatgaaagacgaggagtacgagcagatggtcaaggagc

SEQ ID NO: 924 - DNA, 255 bp, Homo sapiens
ggcagaggcggcgccagccatgttggccgggcggaggtcttcgctgaggcccggggcggggtggcgccacccctgattgcggtgccacggactgctcctgctgggcggagaggacagattttgcaaagcggaggctgcgacgggtcctgcagggggacagtgaggaaagggccgcctcgtctccgctcctgggggaccgcagaaataagaatcaaactccacaatgacaacctatttggaattcattcaacaaaa

SEQ ID NO: 925 - DNA, 255 bp, Homo sapiens
cccagaaactctgaggcggatcccccaacccagtgtcagactgatcgcctttggcccgagggcgaggagccacaggacagtatggccaaagcggcggcctcctcgtcgctggaggacttggacctgagcggagaggaggtccagcggctcacctccgccttccaggacccggagttccggcgaatgttctcccagtacgccgaggagctcaccgacccggagaaccggcggcgctacgaggcggagatcaccgcg

SEQ ID NO: 926 - DNA, 255 bp, Homo sapiens
gcgcgccgctttctgttgccgggcgcaatggcggatacgctggagtcctcgctggaggacccactgcggagctttgtgcgagttttggagaagcgggatggtacagtgctacgactacagcagtatagctccggtggcgtgggttgcgttgtgtgggacgctgccattgtcctttctaaatacctggaaacgcccgagttttctggcgacggggcccacgcgctgagccggcggtcggtgctggagctgggttcg

SEQ ID NO: 927 - DNA, 255 bp, Homo sapiens
gcggccgccggcgaggcgaggcggcccgcgccctgcctgtcaggccaccggcccggcccgcgggctgcccccgatgcggaggcgctgtcgccggggccatgcagcaggcgccgcagccttacgagttcttcagcgaggagaacagtccgaaatggcggggactgttggtctcggccctgcggaaggttcaggaacaagtgcatcccactctctcagctaatgaagagtctctctattatattgaagagctgattt

SEQ ID NO: 928 - DNA, 255 bp, Homo sapiens
ccgagccgggagccgagcgcgctgggcgcggccgtcccgctgccgccgccaagcccggagtgcgccagcggccatggttcccgcggcggcgccgggcgcctgagccccgggacgcaagcgctggaggcgggctgccggctgtgcgggcgctccggagagaccgacagaaggtgagcactgtgggctatgggatggatgaggtggagcaggaccagcatgaggcccgactcaaggagctgtttgacagttttgaca

SEQ ID NO: 929 - DNA, 255 bp, Homo sapiens
aaactttcgtgcgcgttgaaagctgctggcgcggcggggcggactccacccctgcccggcagcccagcgcctccggccgcacttccagctctctgcgcagcccgccgcgcagcccgccgccccagccatggcgaagcccctgacggaccaggagaagcggcggcagatcagcatccgcggcatcgtgggcgtggagaacgtggcagagctgaagaagagtttcaaccggcacctgcacttcacgctggtcaagga

SEQ ID NO: 930 - DNA, 255 bp, Homo sapiens
ggtcgcggctgtggccgggggaagtgaatggttttacccagagggccctgcgccgcctttctccgctggcaacggcgccgctccccgctcctcctccccagccatggcgttcacgttcgcggccttctgctacatgctggcgctgctgctcactgccgcgctcatcttcttcgccatttggcacattatagcatttgatgagctgaagactgattacaagaatcctatagaccagtgtaataccctgaatcccct

SEQ ID NO: 931 - DNA, 255 bp, Homo sapiens
tggggccgcgagtgctgagcccggcgcgcccgagccgctcctcctcccggcctgctccctgggcggagccggggcagtgcggctctgggctggccgaaggggtggcgctgcgatcccgcagggcagcgacgcgactctggtgcgggccgtcttcttccccccgagctgggcgtgcgcggccgcaatgaactgggagctgctgctgtggctgctggtgctgtgcgcgctgctcctgctcttggtgcagctgctgcg

SEQ ID NO: 932 - DNA, 255 bp, Homo sapiens
aatcctcttgattttcttgtgcgcattacccaatcagagaggtcgaggcggggttccacttgaccgctctaagccgccgcgcagcctgcgttttctccggtacaggttgaggctactaaggtacattttgctgggccaggctgggcgggtccccgggatgggcagccctctcgacgagcggcgacgccgtggttgagtctagaaagctagagttgctggacagctatcgcgggagcgcggagggaagtgggaggt

SEQ ID NO: 933 - DNA, 255 bp, Homo sapiens
tctgccccttccccccgcccccgcccgcctcggctcccgcagcgctagtgtgtccgcctagttcagtgtgcgtggagattaggtccaagcgcccgcccagaggcaggcagtccgcgagcccagccgccgctgtcgccgccagtagcagccttcgccagcagcgccgcggcggaaccgggcgcaggggagcgagcccggccccgccagcccagcccagcccagccctactccctccccacgccagggcagcagccg

SEQ ID NO: 934 - DNA, 255 bp, Homo sapiens
gttgtcatgggggaggtggtggcgcttggtggccactggcggccgaggtagaggcagtggcgcttgagttggtcgggggcagcggcagatttgaggcttaagcaacttcttccggggaagagtgccagtgcagccactgttacaattcaagatcttgatctatatccatagattggaatattggtgggccagcaatcctcagacgcctcacttaggacaaatgaggaaactgaggcttggtgaagttacgaaact

SEQ ID NO: 935 - DNA, 255 bp, Homo sapiens
gcgccgtcccgagagcaacaaagttagagtctgcgggccgcactcgcctgcgccccgcacccctccgagcagcccggggatccagcacgcaggtgccagaaccctgtggagcatcatgaactgggaagagtagctgagccccagagcctctctggaagagaaaggaagagccagcagttctttctcccagtgtccgacctcactgtccagcgtcttcctctgcccctgctctgccctccctggctcctggactag

SEQ ID NO: 936 - DNA, 255 bp, Homo sapiens
acgtcggtcgcttccgggagagtccgcgtctcccgcaccttcctctctatcaaacgccgtctctgtggtagccggggccccgcccctcctcggactctacccagtactgaactaggggcagctgggctccagagtccctcgggtctcaggtcatggcggtcgcggggcccgcgcccggagctggcgccaggcccaggttagatctgcaatttctccagcggttcctgcagatactgaaggttttgtttccttctt

SEQ ID NO: 937 - DNA, 255 bp, Homo sapiens
gcggaaactccttggggaaagggcaatcccccgagccggttcccaggccgggtggagaccaactctggggtctgttggtgggagagtggggagcccgtcttctgctgagtgctgccgccccttcccaggacagcggaggtggaacttcgtcgcgctgcaacccccggctcgggatcctggggcgtcctttggcagtcgattgcaccctgcactagagagaagtccaggaatgatatattcttgggctgtatttct

SEQ ID NO: 938 - DNA, 255 bp, Homo sapiens
ctgtttccgggtcggggggcaggagccaccatcgagcttcgcggggttgctgggctgacggatccgcgggccggcatctgaagcgagcgggacgcagcgcggccagggcctccgggcatacgcaggctggtccccaaggcccgcggccgccgccatgtcggtgctgggcgagtacgagcgacactgcgattccatcaactcggactttgggagcgagtccgggggttgcggggactcgagtccggggcctagcgc

SEQ ID NO: 939 - DNA, 255 bp, Homo sapiens
gttgaagcgcggcggcggcaccacgtgggccggaccgggccgggggcggggccgagctgagggaggacctgctggctgcagtgaggagcggaggcgggcgcgggcggccggccatgatcgcgtcgtgcttgtgttacctgctgctgccggccacgcgcctcttccgcgccctctcagatgctttcttcacatgtcgaaaaaatgtccttctggcgaacagctcatccccccaggtagagggcgactttgccatgg

SEQ ID NO: 940 - DNA, 255 bp, Homo sapiens
ccttggccgagaccggtcctctgcggagagggccccgccctctgtgaaggcccgcccgggaattggcggcggcgctgcagccatttccggtttcggggaggtgggtggggtgcggagcgggacttggagcagccgccgccgctgccaccgcctacagagcctgccttgcgcctggtgctgccaggaagatgcggccggagcccggaggctgctgctgccgccgcacggtgcgggcgaatggctgcgtggcgaacg

SEQ ID NO: 941 - DNA, 255 bp, Homo sapiens
atccaccgcaggcttactgtacacatgctagggtccaggacagcaggaccaagccagcagaaacagcctgagcccaccgcagactggcctggctatactggacaatgccactcctcctgtacacctgtcttctctggctgcccaccagcggcctctggaccgtccaggccatggatcctaacgctgcttatgtgaacatgagtaaccatcaccggggcctggcttcagccaacgttgactttgccttcagcctgt

SEQ ID NO: 942 - DNA, 255 bp, Homo sapiens
taagctgtgctagaacaaaaatgcaatgaaagaaacactggatgaatgaaaagccctgctttgcaacccctcagcatggcaggcctgcagctcatgacccctgcttcctcaccaatgggtcctttctttggactgccatggcaacaagaagcaattcatgataacatttatacgccaagaaaatatcaggttgaactgcttgaagcagctctggatcataataccatcgtctgtttaaacactggctcagggaag

SEQ ID NO: 943 - DNA, 255 bp, Homo sapiens
tgcgctttccacctaccagaccctgaaagaaagtgtcaggagccggtgcaaaacccagtttaagttcaagaagacatttgcaagtgcaagaggccaagcagtttgaagaagtgtaagagattttttttccttcgaaagaatatatttttaaagaaaccagccagtccgcggaaagcaacagcagttttttttttttttgcctctttttcttattttagatcgagaggtttttcttgcttttcttccctttttttt

SEQ ID NO: 944 - DNA, 255 bp, Homo sapiens
gacggtcccgctgtcctgcctggccggggccgcactgcgccgcccgccgcccgccgcccgccgcccgccgccggcgacggcaccgccgccctgcgatccggccgcggcggctcagagcgcggctgcggcgggcgcgggcggcggtggctccctcccgtgcgtccgtcgtgggacctttgcccgctcgcccgcgggggacagcgcgcgctccggtccgcggcaggggcggggacgcccggcctgtggcccccgcgc

SEQ ID NO: 945 - DNA, 255 bp, Homo sapiens
gggcgggcgggccgcaggctgtcgggctggggctgaggctgaggctgaggttgaggcggcggcggcggcggccgggtgcccgggacagcgacgcagcgcgccggcggccgcgacagggccagcgagagccccgcagcccgccgcagctgccgcctcgccgcggccgggccggagagcacggcggcgggagcgcggccttaggaggcggccggagcggtgggcacagctcggcgcggagcgtcctgtcaggcggcg

SEQ ID NO: 946 - DNA, 255 bp, Homo sapiens
cggcaggaccgagcgcggcaggcggctggcccagcgcagccagcgcggcccgaaggacgggagcaggcggccgagcaccgagcgctgggcaccgggcaccgagcggcggcggcacgcgaggcccggccccgagcagcgcccccgcccgccgcggcctccagcccggccccgcccagcgccggcccgcggggatgcggagcggcgggcgccggaggccgcggcccggctaggcccgcgctcgcgcccggacgcggc

SEQ ID NO: 947 - DNA, 255 bp, Homo sapiens
gtagaacatggcatagaagacggagctgccgacagccaagacgtactgggaggagaaagcgccgccgtgagcctggctctcccgcaggctgcgtgtcagccacacggcggacggggcggacggggcacgcgttccgagaggggccgccgctacccaccttgtgggcgggcaccgtcctggtcgcccccgggggccccacgacgaagtgcacgtcggccatgagctcgttgttgaacatgagcgcgttcctgcaaa

SEQ ID NO: 948 - DNA, 255 bp, Homo sapiens
gaagtcgcccggcgcgggagcgcgaactctcgcgagaatgccgccagctccggaggcgactgcggcaggagcccgagctctcgcgcgacaggcaccaattcgttagacgcgcgctgcaggagcgcggaacatggcgcggcacgggccaccgtggagtcggttggacgcgcagcaggagcgcgacgtgcgggagctcgtccggggtgtcgccggcctccaggacgaggcagaccccaacttccagctcgccctaaa

SEQ ID NO: 949 - DNA, 255 bp, Homo sapiens
ccaaatcatagatcaagatattttatttatgtatgtcttttaaatgaagagtggttaggatagtcctgattattgcacataaatattgcctttcactagattattgttttgggccaaattttagactattattttaaaaaagagtaccttagtttaatccaacctttccagatacttagaaattattgaaatgtatattttgtgaagatggtcttatgaaagttgttgagctagaaacatgtccttcaccagtgg

SEQ ID NO: 950 - DNA, 255 bp, Homo sapiens
cagtctcctgaatatttacgcgttgctgaatctcctgtggacaaaccaccaataggccaggactgtcctgtggacagacggggtgagcctcttcttgtgtctggagattctgaaaagatttgatcaccaggagatttttcgggacattaccaaaccactcattttagtggctgcctccgggtgatgatggctgtgtgaacgactgccatggcccaccggaagcttgagagcgtggggagcggcatgttggaccat

SEQ ID NO: 951 - DNA, 255 bp, Homo sapiens
ggcgcgcggagccaggtgggaggtgcgaggtggccgcgcggggatcttgggtgacagggcaccgagggaaggaggacgcgagggcagccaggccctagggagcagggagagtggctcgggctcagtcgcgtggccccaggaagaagaaattgtcgagacgaataacatgaggtcatatagaatcccacttttggtgatttcaagtcaagaaagtaaaagtaaaccattgctatctttcaccttaaatatcctgtg

SEQ ID NO: 952 - DNA, 255 bp, Homo sapiens
cgcacgccgagcggctgccgggggaagcagaggcgccggaggctggggcaccgccgacgcctcgggagccatggccgaagggggagaaggaggcgaggacgagatccagtttctgaggactgaggatgaagtggtactccagtgcatcgccaccattcataaggagcagaggaagttctgcctggcagccgagggacttgggaatcgcctgtgcttcttggaacccacttcagaagccaagtacattcctccaga

SEQ ID NO: 953 - DNA, 255 bp, Homo sapiens
cagcccggccggggcctgcgggcgcccagagccgcgccgtccgcgccgcccgttctggttggaagtactccatgacacacactcggagaaagtcccttcccatgctgagttcgggcctcactggccgccgagagcccctgcagatggaagacagcaacatggagcagggggttgagggtgtggagccaggcatgcccgagagcccaggtcacctcacagggcgccgcaagaattacccacttcgtaagcgcccat

SEQ ID NO: 954 - DNA, 255 bp, Homo sapiens
cacagggcagagtccaggagggaattgaatgcagagttcccaccagctctcccgtggaatcagatgtgttgtgttcccagcacccacgtgtggcagtgcacatggagtatcatcagccggaggtgcttccccaagccttggtgtccagagtttttcccggggctctgacatgggcaggattggtccattgatcactcaggtactgcatggccagcccctgctccgtatcctgtcattagccaaggagcaaggcca

SEQ ID NO: 955 - DNA, 255 bp, Homo sapiens
gtcggggaaaggcggggtctcggccggcgctgacgcagccatggcggaggcggctttggaagccgtgcggagcgagttacgagaattcccggccgctgcaagggagctctgcgtgcctcttgctgtgccctacctggacaaacccccaactccgctccacttctaccgggactgggtctgccccaacaggccgtgcattatccgcaacgctctgcagcactggccggccctccagaagtggtccctcccctattt

SEQ ID NO: 956 - DNA, 255 bp, Homo sapiens
gtgcgttcgccctgcgatcccgctcactcttggcgccttcgcggaaggtgcgtccgagccatggccgctgccaacccgtgggacccggcgtccgcgcctaacggcgctgggctagtgctaggccacttcatagcttcggggatggtcaatcaggagatgttaaacatgtctaagaaaacagtttcttgttttgtgaacttcaccagactacagcagatcacaaatattcaagctgaaatctaccagaaaaacctg

SEQ ID NO: 957 - DNA, 255 bp, Homo sapiens
ggcgactttgtcagtaccccaaactgtccccgcatgaggtcactctgcacggtcacgtgctcgagcccgcgggagcgccacatcgccagccgcacccctccacccccaacctgcccacgtgacccggcctagtttctccaggcccgtccctacgtctcactcgggaagccccgccccacgctgagcgctccgcctgcgaccctccgccacttacccaccccggctcaagcacgacccgtggatccacgtgctttt

SEQ ID NO: 958 - DNA, 255 bp, Homo sapiens
aatataagtggaggcgtcgcgctggcgggcattcctgaagctgacagcattcgggccgagatgtctcgctccgtggccttagctgtgctcgcgctactctctctttctggcctggaggctatccagcgtactccaaagattcaggtttactcacgtcatccagcagagaatggaaagtcaaatttcctgaattgctatgtgtctgggtttcatccatccgacattgaagttgacttactgaagaatggagagaga

SEQ ID NO: 959 - DNA, 255 bp, Homo sapiens
ggggagctatgaaccttaagattagaccactaactcgaatctaaatgagctgcccttgtctcctacaaaagaaaagttgggcaggtagggtattctaatgagggtttctctttctcttaagcaaatgatgatcaaagttaactgacaaactgtcacggaatctgccagacctcactctggccttgctgcttctctccagctcctgaacttttctttcttccatcatgctctgagcccattccttgaaaactaaaa

SEQ ID NO: 960 - DNA, 255 bp, Homo sapiens
acactgcgtccggggccagacgacgatatcagcgcggggtccccacaacgccatggggcagagccaactctcgagcgcgtgatcgaagcccgcagttttttcgcccccgtcacttccgggtgcgacaatctcttctgtccggccagccgctggagtcgttaggtgccgccttgcttctgacgagccacacgtttgcttcttccctgtgttcccagctggagggacatgagtgtccctgggccgtcgtctccggac

SEQ ID NO: 961 - DNA, 255 bp, Homo sapiens
agcgtcaggtggcctcggtgtcctccgcctgtgcgccccagcctgcggggccgcccttcagggcgcgcaaggggcgagtctgtccagccggcagcaccccaggccggatggacgcttgttcctggttctgtgccccgtgagcgctcaacgccctggtgtgttcactgaccatggtgcctgggctgcggcgccgggcggggcacggcgggacttttcgggacctttcctggggggagcctcgctttccccgcctcc

SEQ ID NO: 962 - DNA, 255 bp, Homo sapiens
ggttggtgccttagcaactaaagctggcaactgggacatcgtccggtgctgcaggtctcagccgaagggcgtcggaaactgcgctcgcatcgagcagtttccagcctcctgggtaaaggagcagtctcctcccttgcttgggactctggacgcatctcattccggtgaaagtaagggacagcttaggaccagaagcctttcgcggagaaaaggctgacatgcccgtcctatatgacaggttactgaagctaaagg

SEQ ID NO: 963 - DNA, 255 bp, Homo sapiens
ctcgcaatgcaaatcgggaaaagggggtgagctgggctggcttccgtcctggtagccaaggctaattctccctcgagttcttgggagatgggcatttggcgagaaggctggcgttagtgaagcgcgcccggcgtcacggaaagaagcacttgtaaggaaatatagcatccattgtgaaagtggaaaagtaaagataattcatcatgcctgctgtggcttcagttcctaaagaactctacctcagttcttcactaa

SEQ ID NO: 964 - DNA, 255 bp, Homo sapiens
ctctgggctgctcgggcgccaccactactgtccccatcccgccccgccagctgggccaaagggtgacttgactcacgacgctgccaccagcccacggcttgcccgaggcgtataaaggctgccagggccgcaggctgccaagccctgccctgcccaaggcgcatagagcatggcccgaggcgctgagggaggccgtggggacgcgggttggggcctgcgtggcgccctggcggccgtggcgctgctctcggcgct

SEQ ID NO: 965 - DNA, 255 bp, Homo sapiens
cccctcttcctcgccctctctcgcgggtcggggttacatggcggcgactgcggcaaagcgagagcctcggagacgccgctgccgccagcacagccggagacctgagccgacactgggggcagtccgcgagccccgcactctctcgatgagtcggagaagtcccgttgtatcagagtaagatggacggtagctttgattgtgattgtggtgagctggagccacctgatcactaacaaaagacatcttctgttaacc

SEQ ID NO: 966 - DNA, 255 bp, Homo sapiens
cttccctccgccccgcgccgcggctggcagggtgtgcgtgagtttggtggcggccggctgtgcagagacgccatgtaccggctcatgtcagcagtgactgcccgggctgccgcccccgggggcttggcctcaagctgcggacgacgcggggtccatcagcgcgccgggctgccgcctctcggccacggctgggtcgggggcctcgggctggggctggggctggcgctcggggtgaagctggcaggtgggctgagg

SEQ ID NO: 967 - DNA, 255 bp, Homo sapiens
ggcggattggcgggcacgccccctcgcccgcggccccctccccgcctctctccaccgcctcctctggctccccggtcagagggccggagcgagaagatggcgaagacgtacgattatctcttcaagctcctgctgatcggcgactcgggggtaggcaagacctgcctcctgttccgcttctcagaggacgccttcaacaccaccttcatctccaccatcggaattgattttaaaattagaacgatagaactagat

SEQ ID NO: 968 - DNA, 255 bp, Homo sapiens
acccaccgaaccccgcccgcgccgggagcatctcgcgtccccaacgggcccccgggtcggtttccgcggtggccatgactgcggccgtgttcttcggctgcgccttcattgccttcgggcctgcgctcgccctttatgtcttcaccatcgccaccgagccgttgcgtatcatcttcctcatcgccggagctttcttctggttggtgtctctactgatttcgtcccttgtttggttcatggcaagagtcattattg

SEQ ID NO: 969 - DNA, 255 bp, Homo sapiens
cccggatctcggagttacacgttctacggagcggggcgccgggagacggcgggcgagaaaacccggcgtccggaagcccgtgctttctttgacgcaagggctcgagacgcagccgccgtcggccgagcgcccggctagaagcgacaccagacggagcctccggagttcctccgcccccacctcgccgggtcctggagccgcagtcctcccagctgccctcctcgtggccatggagtgtccacacctgagctccag

SEQ ID NO: 970 - DNA, 255 bp, Homo sapiens
aggtctccgcccctcggatcccacggggtcccttgcggccctcccactcctcgcaccgttggatcgctttgctcacggcgctatctctcgataaagttgttgttgcggcttccgccgcgggtggaagaagatggcgtcgggtggtggtggctgtagcgcttcggagagactgcctccgcccttccccggcctggagccggagtccgagggggcggccgggggatcagaacccgaggctggggacagcgacaccga

SEQ ID NO: 971 - DNA, 255 bp, Homo sapiens
atgatcccaaagagcctggtccaggcagcggaaacccagaggggtctctgcgagccaggagggaaaggaagagaggggagaagtggaggaaaaggggagacacgccccagaggagttggaacgcaggagggaaaggggaccatacccggtagcccgagggaaaaacgaggcgagaggggagaaggcgaccccgcgctgctacccgcggaagatttatggcgcctcccgggttccaaggacaggctgcgttcgtcg

SEQ ID NO: 972 - DNA, 255 bp, Homo sapiens
gagggaggcgccctggagtctcccctccagcgagaggggctgcgcgggccgggccgggccgggctgggctggagcagcggcggccgcgggagccgagcttgcagcgagggaccggctgaggcgcgcgggagggaaggaggcaagggctccgcggcgctgtcgccgccgctgccgctcactctcggggaagagatggcggcggagcggggagcccggcgactcctcagcaccccctccttctggctctactgcctg

SEQ ID NO: 973 - DNA, 255 bp, Homo sapiens
cgagcatggccgctccgcgagtattcccactttcctgtgcggtgcagcagtatgcctgggggaagatgggttccaacagcgaagtggcgcggctgttggccagcagtgatccactggcccagatcgcagaggacaagccttatgcagagttgtggatggggactcacccccgaggggatgccaagatccttgacaaccgcatctcacagaagaccctaagccagtggattgctgagaaccaggacagcttgggct

SEQ ID NO: 974 - DNA, 255 bp, Homo sapiens
gtggcgcggacgcctgctcagtgcgcgccggccgggcaaccctatgctggcgtaatcgggttcctccgagccgccgtaggactggttccggcgggctggtgaggaatggagccggtaggctgctgcggcgagtgccgcggctcctccgtagacccgcggagcaccttcgtgttgagtaacctggcggaggtggtggagcgtgtgctcaccttcctgcccgccaaggcgttgctgcgggtggcctgcgtgtgccgc

SEQ ID NO: 975 - DNA, 255 bp, Homo sapiens
ataggcctcctcctggcgcgcctccgcaccgcattggtggaccggcccccagcccgtccatgggcgttgtggccgccaccgcaggttccgcctcccgttccctccgccctcaacgtacgtcgcaccgcctctctgtagccgcccgcggagcatcgcagccggcccgggcccccgccagcctccctcctcgcgtccctcggtgtcctccgcgggccggcgcgatgcggctgggcccgaggaccgcggcgttggggc

SEQ ID NO: 976 - DNA, 255 bp, Homo sapiens
gagaccaaaagtcaggtaggagcctccggggtccctgctgtgtcacccggacaggccgtgggggcgggcaggggggcggggccgggcctgaccacagcggccgagttcagtcctgctctccgcacgccaccttaggcccgcagccgtgccgggtgctcttcagcatgtccttcatcccggtggccgaggattccgacttccccatccacaacctgccctacggcgtcttctcgaccagaggcgacccaagaccga

SEQ ID NO: 977 - DNA, 255 bp, Homo sapiens
cacatttgtcctgagtcacctgtccagagcaggtggtgaatattgtgtcctactcacggcatctcaactatcggagcctgggatctgactcaaaggccggcctccgtctgagaactgagcgtccatttctcaatccttgccggctctgacccaggcctgggccacaggctgtccgggaataagtggtgctgcaatccctgctgggcagatggagagaggagcaagggagatggcagccccgggggactgtgcata

SEQ ID NO: 978 - DNA, 255 bp, Homo sapiens
agccctcctcccctttccccgcccactccgggctggccttatccagtagcgtctgggtccctggactaaagccgtcaaatgtaaccaattgctgaggagctctcccctaagaatcccgcctccactctgaggaacagcttcgctgatcaatggatcccctcctagacgcaatgagcgcgcggggcaagtggagaagcggctgaactgcccaatgaacaagcggtttccgtggttaggggcgtggcagaagcggtc

SEQ ID NO: 979 - DNA, 255 bp, Homo sapiens
gcgatcgcggcggcggcggcggcggcgaggagctgtgccttccacctctccagccccggcaggacgggggcggccgccgcgaacccggggcggggacagcacgcagcctcgaggcgcgcacccccgcccggcagcggccccgacacccggggcgagcgggaaagcggcagcggcggcggcggcggcggcggcgggggaaggatgcaggggaagaagccgggcggttcgtcgggcggcggccggagcggcgagctg

SEQ ID NO: 980 - DNA, 255 bp, Homo sapiens
attattaccactccaaagcttgagaaggaagtcacataactgtgacagcaggtttgcaaaaccaatgaaaaaaacagttttccccaggcagggaggaattttttttataattaaatactgaaagttggaattcctatgatcatcaaagtcactctcaggaattagaagcaagtttacatgtcatctttattttttgctttagtcctctttgatacgcaacctacggctctctgagtccttgaaaaagaaccaact

SEQ ID NO: 981 - DNA, 255 bp, Homo sapiens
atcttgtagaaaatttcagctgtagcccttggactagaagctgaaataacagaagctgtgtacgatgcattagggtattgaagaaaattaacttttgaattaaatatttggaatataaggaaataaggaaagttgactgaaaatggggcggaagaaaatacaaatcacacgcataatggatgaaaggaaccgacagactttaagaaagaaaggccttaatggttgtgagagccctgatgctgacgattactttga

SEQ ID NO: 982 - DNA, 255 bp, Homo sapiens
gtcatttagccgcgcctaggttttccggcgccggccctaggtcccggcagcggtggtgacggcggtgccggaggttgtccttggcaggttttcctcggcgcttctccatggaggaggcggtgcgaacggcttcagccccgaatgctcgcatctcccactggacggcgacgaaggcggtggccgtgcgagcgcaggactgggcggcctgtgtgggggtgtgagccgcggtgcccaaggctgcgccggcgaggggaa

SEQ ID NO: 983 - DNA, 255 bp, Homo sapiens
gcgccggctgagccagcggctcttgggaggctgcgtccgcgcgccggcgaggcgaggcggccgggccctgcgcgtcaggcctgagacctgggaggaagctggagaaaagatgccctctgaatctttctgtttggctgcccaggctcgcctcgactccaaatggttgaaaacagatatacagcttgcattcacaagagatgggctctgtggtctgtggaatgaaatggttaaagatggagaaattgtatacactgg

SEQ ID NO: 984 - DNA, 255 bp, Homo sapiens
agaaagggcctgggcggccgcactgagagctttacgcccggaggcgtcggcgctgccactggcccgcgacgggaacggggcgaaaaggcggcggcaccatgttctccctcaagccgcccaaacccaccttcaggtcctacctcctgccaccgccccagactgacgataagatcaattcggaaccgaagattaaaaaactggagccagtccttttgccaggagaaattgtcgtaaatgaagtcaattttgtgagaa

SEQ ID NO: 985 - DNA, 255 bp, Homo sapiens
cagagctgctgtcatggcggccgctctgtggggcttctttcccgtcctgctgctgctgctgctatcgggggatgtccagagctcggaggtgcccggggctgctgctgagggatcgggagggagtggggtcggcataggagatcgcttcaagattgaggggcgtgcagttgttccaggggtgaagcctcaggactggatctcggcggcccgagtgctggtagacggagaagagcacgtcggtttccttaagacaga

SEQ ID NO: 986 - DNA, 255 bp, Homo sapiens
aaagtacttcccgaatcccagccactgtctcttgtaggcagggatcacagtctgaaacgacagcaaggaagaggtaggcagggaaaactaactggaaggaagtttaaatacagaaagagcaaagtattatctaactataacaatgccacattttactgtgactaaggtagaggacccagaggagggggcagcggcttcgatctctcaagagcctagtttagcagacataaaagcccggattcaggattcagatga

SEQ ID NO: 987 - DNA, 255 bp, Homo sapiens
agcgccgccgccgccgctgctgcagcagcagctgctctgcagagtggtggccggggccagggccggggtgccctccctcccaccttctcccgccatgagccagggaagtccgggggactgggcccccctagatcccacccccggacccccagcatcccccaaccccttcgtgcatgagttacatctctctcgcctccagagggttaagttctgcctcctgggggcattgctggcccccatccgagtgcttctggc

SEQ ID NO: 988 - DNA, 255 bp, Homo sapiens
gtgtccctgctccgctcctctcagtgagtgaaagtggccgccgccgccgccggcccagcgcccgcagccgcctcagcgccgccgccatcttggggtcccaggagccgcggagggagcgagctaggagcgtccacgcccaacgcagtcaccgtcccacggcctcagagagcgaaccgcggctccaccgtcggcggggcgacccccccctccggaccccgcccgcaccccgccccccctccgccgccgtcgcggcgg

SEQ ID NO: 989 - DNA, 255 bp, Homo sapiens
gagctgtgcttggggcggggcctggcgtgtattcgaaaggaaggcgccggctgcgggaagatggcggctcagccgctgcggcatcgctcacgttgtgcaacgccgccccggggggacttttgtggtggcactgagagggcgattgaccaagcttcttttacgacctccatggagtgggatacgcaggtggtgaaggggtcctcgccgctcggccccgcagggctgggggctgaggagccagccgccggcccgcag

SEQ ID NO: 990 - DNA, 255 bp, Homo sapiens
aaagattaaatgtaagcgctgtcaccaggccttctgagtgcagctggcaccatgggtgtgctccagagcaacttctgcttgctctgagccccctgccctgcctcccctttcaccatgtttcctctgacaagattttaagtacagcaattcaagaagatttctcctcctaaacgacatttatctgaagtctattgcctcttgattgctggaaaagaatcttaaaatcatttcaaaagtaacttataaacaaactta

SEQ ID NO: 991 - DNA, 255 bp, Homo sapiens
ccgggtccctccccatcccgcgacccaacggtcgttccccgccgccggccccgcccctccctggccgcccgcggcgcgccggcgcctgcgcagtcgccccagagcgccccgaccgggatggcggccgttttggagtcgctgctgcgagaagaggtgtcggtcgcagccgtcgtgcggtggatcgcgcgcagcacccagggttcggaggataacgctggggaggcggccgcgctgagctcactccgggccctgcgg

SEQ ID NO: 992 - DNA, 255 bp, Homo sapiens
gaaagtgaccggaagtaaccgccgggccaagatggctgcagaggaaggggtcgcgagtgctgcttccgccggcggtagctggggcaccgcggccatggggcgggttctaccgatgctgttggtgccagtccccgccgaggcgatggggcagctcggctcccgggcgcagctgcgcacacagccggaggctctggggagcctgacggctgcgggcagcctccaagtgctttctttgacgcctggcagccggggcgg

SEQ ID NO: 993 - DNA, 255 bp, Homo sapiens
aagaggaagtcgcgctgctgtggcggccgctgtagcagcggcggtccagtcgtagcccggccgcccgcgcctgtccggtccggtccggccacggaggcagcgcagcggcgggactccgagcctaccccgccgagtgagctgcgccgcaccgtgccgtcccacccggcacccaccagtccgatggggccgcagcggcggctgtcccctgccggggccgccctactctggggcttcctgctccagctgacagccgct

SEQ ID NO: 994 - DNA, 255 bp, Homo sapiens
ccggggacggctgctggagcggcgcccgccgcggctcagcgcattcccgctctccgcttccctctccgctgcgtccccgcgcgaagatggcaaccgaggggctgcacgagaacgagacgctggcgtcgctgaagagcgaggccgagagcctcaagggcaagctggaggaggagcgagccaagctgcacgatgtggagctgcaccaggtggcggagcgggtggaggccctggggcagtttgtcatgaagaccagaa

SEQ ID NO: 995 - DNA, 255 bp, Homo sapiens
accccgggcaggtggagcgctcgcggctgctcgcggcgagcccgggagtgatggcgaggcccctgcgggcggccagcgcctgaggcgccccgccccgccccgccccgcgcggccctccccgcccggccctgccctgccctgctccctgccggcggctgcgggcgcttcctagtccgctcgggcggccgcccaggcgaggtgcggcctccgcacaggcggggggcgtaggcgcgcggggcccgccatggctgcgtc

SEQ ID NO: 996 - DNA, 255 bp, Homo sapiens
gccattttcgcgggcggaggcggcccggcgggccctgggagagctgggacgggcggcggccgggtggcctcggccacccgctaattgcatcttttcccggcgtctcgtctgcagagggagcactatgtctgcggaagtccccgaggcagcctccgcggaggagcagaaggaaatggaagataaagtgactagtccagagaaagcagaagaagcaaaattaaaagcaagatatcctcatctgggacaaaagcctgg

SEQ ID NO: 997 - DNA, 255 bp, Homo sapiens
gatgcctgttttgaaagttgatggagcgaactgcttttccaaagactcttttgaaaaactttttaagtaggccattctgactttaacatttctctttgtcttaacattagacaaaaagtaaccttcctgaagaggacatgtgattggaagttgtcaattgttgaagcattggtaactccagtctctaacgttttagaaaatcataacaagcggttctctaccctgtaaaggtgaactactgagttcttcattatg

SEQ ID NO: 998 - DNA, 255 bp, Homo sapiens
acggcatgcactgcggcgcccagccggtcaccgcctgccggctgcagacgcctgcgagcaggttgtttttataagaggcgtcattggcgcccgagctgtgaccgccgccactggggcagccagcacaatcgggcggaggtggcgctgccccttcaggtactgtactaggcgggcttagaccccgggagggggtttgtgccgactgtctgagtccctggccgacacgctcggctcagtagaggagcagtggcgggg

SEQ ID NO: 999 - DNA, 255 bp, Homo sapiens
acgcggctgccggaagcgggtctggagcgggcgagacgaccagggccggcgagcgcagtgcagcgccgcgcggtgcgggcggccgagtgggggcgtcatggaggatgagcggagcttttcggatatctgcggcggccgcctggcgctgcagcgccgctactactccccgtcctgccgggaattctgcctcagctgccctcggctctcgctgcgttcgctcaccgctgtcacctgcacggtgtggctggcggccta

SEQ ID NO: 1000 - DNA, 255 bp, Homo sapiens
ataaaagctgcccggggaagccaggagagcgaagggcggacgtactcgccacggcacccaggctgcgcgcacgcggtcccggtgtgcagctggagagcgagcggccaccgggagcccccggcacagcccgcgcccgccccgcaggagcccgcgaagatgccccggcgcagcctgcacgcggcggccgtgctcctgctggtgatcttaaaggaacagccttccagcccggccccagtgaacggttccaagtggact

SEQ ID NO: 1001 - DNA, 255 bp, Homo sapiens
cgagccgcgaagattgtttttgtcccgccgaaatcgagcaaagcacgctggaacttgtagtccttgaggccccttccctaggtccttcgagctactccgtctggccccgccttttctctgctctcctgaacctttaggcttgtctcggcccatttgaagaccaggaagttgatcaatcccgaggctgctgagagacggtggcgcgattgggacagtcgccagggatggctgagcgtgaagatgcagcgggtgtcc

SEQ ID NO: 1002 - DNA, 255 bp, Homo sapiens
gagagaccttggagcgcgcgggaaagagaccaatataaactgtggcgggatagttttcgggtccttgtccagtgaaacaccctcggctgggaagtcagttcgttctctcctctcctctcttcttgtttgaacatggtgcggactaaagcagacagtgttccaggcacttacagaaaagtggtggctgctcgagcccccagaaaggtgcttggttcttccacctctgccactaattcgacatcagtttcatcgagg

SEQ ID NO: 1003 - DNA, 255 bp, Homo sapiens
agtccctatttggaactgctctcgcggcagttcagacctcgtgctcgtccccttcgcctgtctgtgtgtggtatccgtaggtccggggcacttttttttttggtgtgtgtgtgtgtgcgtgcgcgcgtgtgtgtgtgttgggtgtgtgtgttttgggggtttgccggggcgcggagaggagagccgggccgaggggaaggaaggaagccgtagagctccccggtctcgggctgcgtctcccctccagcgctctcc

SEQ ID NO: 1004 - DNA, 255 bp, Homo sapiens
caacagaaaccaagcagcaacagcccttggaaagaggctaaatttttcttgacttctgcagcaacaaagaccgtgaaaagttggcacttctggcctaacgctgccgtcatcctacccctcaccccagggcaacccaggctggacatttagtgcctccctctttattcctctgtgatcatccagatcagcacttgactgtttattttcaaatctcacgaacctcaccccaagatcttcacattctggatctcagct

SEQ ID NO: 1005 - DNA, 255 bp, Homo sapiens
acgacccggagcgaaggtctcgcgaggcctgggcgctgcggcggcaggaggaggacggggaaggacggagccgagccgcggctgcctccctcgctcactccctcgcgcactcgcccgccccctccctccctcccctcccttccccggccccggctctggccccggcccattcgctgttgggtcttctgctagggaggatgtcgggttcgtcgctgcccagcgccctggccctctcgctgttgctggtctctggct

SEQ ID NO: 1006 - DNA, 255 bp, Homo sapiens
aacggtagcgccaggggccttccggaaagaggagcgagagcccggcgatggcggctgcgccggccttgaagcactggcgcaccacgctggagcgggtggagaagttcgtgtcgccgctctactttaccgactgtaacctccgcggcaggctttttggggccagctgccctgtggctgtgctctccagcttcctgacgccggagagacttccctaccaggaggcagtccagcgggacttccgccccgcgcaggtcg

SEQ ID NO: 1007 - DNA, 255 bp, Homo sapiens
ccctggccaatgggaagtgagggcgtgactttaagtctttctttcattggcccagggtcccaggccgtccaggtcttggggcgccgcggcggaaatcgcgcggatgccagaacgcgctctcagcttcgggtcctgcggctgcggctgccgccatcatggtgcggaagcttaagttccacgagcagaagctgctgaagcaggtggacttcctgaactgggaggtcaccgaccacaacctgcacgagctgcgcgtgc

SEQ ID NO: 1008 - DNA, 255 bp, Homo sapiens
gccccggtggcggaggacgtcccggaggatccctctggtcgggcgcctggctttgtgtagccagccaggctggagtgcaatggcgcgatctcggctcactgcaacctctgtctcccaggttcaggtgattgcccacagtgagtatcaaaagtccaaaagaatttccatctttctgagcatgcaagatgaaattgagacagaagagatcatcaaggacattttccaacgaggcaaaatctgcttcatccctcggta

SEQ ID NO: 1009 - DNA, 255 bp, Homo sapiens
aaaatgcccagaccagcatccgaaagctggtctcctatacaaagcagaatccctgcctacaaagcagtttcccacctccgactcctccccacggcgaacagcccttctggatccaaccaacccaccaaccccaatagggcccagcacccagagggtccacaatccagagaaggagctacaagccctgtacttgcaagcctcgaacccccaactccaactgacctcccctctgccagagcaagaccacgagtaccc

SEQ ID NO: 1010 - DNA, 255 bp, Homo sapiens
atgaaaacctcgaaggcatcccagcgctatagaggcatccggagaaatgccagccagtgctacctctaccaggaatctctgctgctcagcaacttggatgacagctttagtgctgatgaaacaggggacagcaatgatccggaacaaatcttccagaatatacagttccagaaagatctcatggcaaacattcgctgcagaccctggactatgggacagaagctgagggcattgagacaagcgaagaacattgtg

SEQ ID NO: 1011 - DNA, 255 bp, Homo sapiens
gtgcctttaagacctcagcgcgcggccctgattgagaaatccgcgcgcagcctccgccgctgcacactgcagcctctgctgaacccctgccgcgccgccgccttcgccagcccggaccggaccggcccgccttcccttcctccgctccagccggcctccggccccgcaacctcctcctcggcgaagtctccctggccgccccatgtcggccgcccccgcctacagcgaagacaagggcggctccgctggccccgg

SEQ ID NO: 1012 - DNA, 255 bp, Homo sapiens
gcagagggctcttccggcgccttcccaggcggggatgctgcggctccgcagcgggctgaggcaccttcgggcaacacccaatactcggggctccgctcggcttctttgcgccgagatgcctaagaaggctggtgcgacgaccaagggtaaaagccagagcaaggaaccagagagaccacttcctcccttaggtcctgtggcagttgatcctaaaggatgcgtcaccatagccatccatgcaaaacctggctccaa

SEQ ID NO: 1013 - DNA, 255 bp, Homo sapiens
ggaagcggtcgttgccatggatcctggggacgactggctggtggaatccttgcgcttgtaccaggatttctatgcattcgacctgtcaggagccactcgagtccttgaatggattgatgacaaaggagtctttgttgctggctatgaaagcctgaaaaagaatgaaattcttcatctgaaattacctctcagactttctgtaaaggaaaacaagggcttattcccagaaagagatttcaaagtgcgccatggagg

SEQ ID NO: 1014 - DNA, 255 bp, Homo sapiens
acatttctgcagccgcgcggcgagccattcgcggcggctgctgcagctcctactgcatcttccttctcttcctttcctcgggctccggtctcggagtcggagagcgcgcctcgcttccagagcccccggacccggcgagtcagcgatcgccgagccggccaccatgcccggcagaccgcgccactaggcgctcctcgcggctcccacccggcggcggcggcggcggcggcggcgtccgcgatggtttcagacgct

SEQ ID NO: 1015 - DNA, 255 bp, Homo sapiens
agttccggtggctggcggaaacgggaacgtgcagccgcgggtgcaggagtcctggggcatggcgggggcggggcagggggaggcgcgcacagaacaggctggggcatccctcgccctggctctttgagcccggaccagacaggtgctgggaatacagcaaggaattagaccagttccctgctctctggtatggtgggacagatactaaaaagagatgtgataatggatcatcatgtttctaccatcaagcctcga

SEQ ID NO: 1016 - DNA, 255 bp, Homo sapiens
ccggcccggaagtgcgcaggcgctggcaagatggcgggaggggtgctcccgctgaggggcctccgcgccttgtgtcgcgtgctgctcttcctctcgcagttctgcattctgtcgggcggtgagcaatcgcaggcgctggctcagtcaataaaggatccgggcccaacacgcacattcacagtagttcccagggcagcagaaagtactgaaatcccaccttatgtgatgaagtgtccgagcaatggtttgtgtagc

SEQ ID NO: 1017 - DNA, 255 bp, Homo sapiens
gtactctgcgctgggcgcgcggaggcctaggcgggaagctcgagcggcggcgccatggcccgagcgtggcagcacccgttcctcaacgtcttcagacacttccgggtggacgagtggaagcgctccgccaagcagggggacgtggccgtggtcacggacaagaccctgaagggcgccgtgtatcgcattcggggctcagtctctgccgccaactacatccagctccctaagagcagcacccagtctctggggctg

SEQ ID NO: 1018 - DNA, 255 bp, Homo sapiens
ggggacagcgcggggccgagaaccggaagtgcggggcgggcgcgggggcagagcgaaaggcttgaggaccaggtcggggccgggttccgggtcggggagcggctccgggcggcagctatgaggcgggacgtgcgcatcctgttactgggcgaggcccaggtggggaagacgtcgctgatcctgtccctggtgggcgaggagttccccgaggaggtccctccccgcgcggaggagatcaccatccccgcggacgtc

SEQ ID NO: 1019 - DNA, 255 bp, Homo sapiens
ccgctctgaggactggagggaccagccgcccacagagccccgagcccgtggtcccggcgagaagaggcacgcgcggcacaggccggcctccgcttcccgggaagacggcgcactcctggccctgggttcttgctgctgcccaccctctgctccctgggatgggccccgaggcgagcagcttcagcacaggcctggccctgctccaggtgcaggaaggaggataaggccgggccgagaggcggcacacctggacca

SEQ ID NO: 1020 - DNA, 255 bp, Homo sapiens
atgacagtgaagttgggcgacggcggcagcggggaggacgggctcaagaagctgggcaagcgggcggccgatgaggagtccctggaaggagaaggggccggcggcgcagacgcggccgaggagagcagcggcacaaagagggacgagaagaccccccgggccggcgccgacggcccccccgcgccccccggcgcgccgcaggcgccgtccccgccgcagggcagcccccaggaccagcaccacttcctccggtcc

SEQ ID NO: 1021 - DNA, 255 bp, Homo sapiens
ccctgaggcgacagcagctgcgggaggcgacgggctgcggcctgcggaacctgaggcagctggggagggccgggcgcgccggccggatagcgagccgcgctggcggcggcggtggccgcgatgatggagatccagatggacgagggcggcggcgtggtggtgtaccaggacgactactgctccggctcggtgatgtcggagcgggtgtcgggcctggcgggctccatctaccgcgagttcgagcgcctcatccac

SEQ ID NO: 1022 - DNA, 255 bp, Homo sapiens
gggagtgtggcgttctgtgaagagttcggtgctaacctccctcacgcggcggtggctgccgggaccctagcaggtttcagctggagcggcggcggcggcaacatggcagagaccgcggccggagtgggccgcttcaagaccaactatgctgtggagcgcaaaattgagcctttctacaagggcggaaaagcacagctggaccagactggccagcacctcttctgcgtctgtggcaccagagtcaacattctggaa

SEQ ID NO: 1023 - DNA, 255 bp, Homo sapiens
gcactgcagcgccagcgtccgagcgggcggccgagctcccggagcggcctggccccgagccccgagcgggcgtcgctcagcagcaggtcgcggccgcagccccatccagccccgcgcccgccatgccgtccgcgggccccgcctgagctgcggcctccgcgcgcgggcgggcctggggacggcggggccatgcgcgcgctgccctaacgatgccgcccgccgcgcccgcccgcctggcgctggccctgggcctgg

SEQ ID NO: 1024 - DNA, 255 bp, Homo sapiens
attaaaagccggacgcttccggtggaagggagctgttgcggggcttgctgggatcatggcggagaatcactgcgagctcctgtcgccggcccggggcggcatcggggcggggctggggggcggcctgtgccgccgctgcagcgctgggctcggcgccctggcccagcgccctggcagcgtgtccaagtgggtccgactcaacgtcggcggcacctacttcctcaccactcggcagaccctgtgccgggacccgaa

SEQ ID NO: 1025 - DNA, 255 bp, Homo sapiens
gtttgtccctgaccgtgcgccgtccaagggtccattggttgccatagagatcgtcgagcgctgggcctgtgatcgctgaggggcgagcagttgcgaccctgggctcctggggacctgagcgttatgtctttccgcgacctccgcaatttcacagagatgatgagagccctgggataccctcgacatatttctatggaaaatttccgtacacccaattttggacttgtatctgaagtgcttctctggcttgtgaaa

SEQ ID NO: 1026 - DNA, 255 bp, Homo sapiens
acgtgcagggctgtccttggagggccagcacagccccttccaagtgggcaagacccaggggtggctcaaaagatagctgtgccctagccctggaacctctgaatgttgatttttgtagcaaaaaaggacttgcagatgtgagtaaaggctgttgagataaggacatcctccctgctctctgggaggaccccaaatgcaggtgcacagatcttaagaagaagaggcagagactggggtgatgcagccacaactaag

SEQ ID NO: 1027 - DNA, 255 bp, Homo sapiens
cgcctctacgcgcgcccgccgttcccgcgaggcccacctagagccgggcggcgcaggcgcagagtccccgggccaagatggctgcgcggtgctccacacgctggttgctggtggttgtggggaccccgcggctgccggctatatcgggtagaggggcccggccgcccagggagggcgtggtgggggcatggctgagccgcaagctgagcgtccccgcctttgcgtcttccctgacctcttgcggcccccgagcgc

SEQ ID NO: 1028 - DNA, 255 bp, Homo sapiens
cagcccgggaatcaaccaccggaagtgccggccctgagaggtggagtcggggtggcagcggcggcggttgccaggagcccgcgttgcagcctgagatccgtaatatggcggggaggaggaggagaaggcggcggcggaccgagctgcgctctgtcagtaccatttgagccattcgcttcctgacaaggcccgtggcgaggggagaggagctgaaggggccgtgggggatcagtgtgactgtgggaagatggagga

SEQ ID NO: 1029 - DNA, 255 bp, Homo sapiens
atagaaactacggcactctggccgtggccgacgttgctcctccgaagcatggcgccggcgggagttgtaacccgggctgtccggagcggggagctgcccctcacaagcatggcgtcagctgaaaatgaagcctgtgctgtgcggagcgtcgcctgcccctcacaagcatggcgtctgcagaaggtgctgtgcggccgctgcggggcggccagctgcccttcacaaacatggcggccgaggggtgcggggagtggc

SEQ ID NO: 1030 - DNA, 255 bp, Homo sapiens
ggtttggtccggcctggcctactggaccagcctgtgctcggtcggccacggctctgctgggctcctggcgccgcctcctcccagcccgccgcgggctgcgcgcttctgtgggtgggggaaggcaggactgacgcagaatgacaacggcaacacgacaagaagtccttggcctctaccgcagcattttcaggcttgcgaggaaatggcaggcgacatcagggcagatggaagacaccatcaaagaaaaacagtaca

SEQ ID NO: 1031 - DNA, 255 bp, Homo sapiens
ggaagggaagggggaggtgccgaggctgcgcgccggctgctcctccccacccccagcctttgccctgaagggggctggatgggcaaggcggccgcgatggctcgagctcgggcggtggcggcggtggccggaggcggcggtgcctcctcctcctcgccccggcgccggcggtgatccgagcgagcggccgcggcccccgatgagactgctggcgggctggctgtgcctgagcctggcgtccgtgtggctggcgcg

SEQ ID NO: 1032 - DNA, 255 bp, Homo sapiens
cgcttctgctcaacctagaccagccccagcttcagcctcagctcccctccttcctggatcgagcgcccgcactcccggccctgcagccacccgagtcccgctcgctgtcgcctgcacgcgagtcccccctggcacgcgctcccacatcccgggatcgtcccaacggcccctgcgcccttcctgggatcactccgactgccccgcgcgccctgggatcggtccatctaccccgcgtggccccagctgcttgcccgg

SEQ ID NO: 1033 - DNA, 255 bp, Homo sapiens
aagaggaaacgctggggccggcccgctcccccccacgtgtccgccggagtttctccaccagcaacatggccgccgcctgagaggagagccgggccgccgccgtctctgcagcccgcgggtaactgggccgttgccgccgtccgcgctcggcccccgcggagagatcgagctgaaggactgcgcggctggctctcctctagtatggccaatgaagaggatgacccagttgtacaggagatcgatgtgtacttggcc

SEQ ID NO: 1034 - DNA, 255 bp, Homo sapiens
gagcggtgcggaggctctgctcggatcgaggtctgcagcgcagcttcgggagcatgagtgctgcagtgactgcagggaagctggcacgggcaccggccgaccctgggaaagccggggtccccggagttgcagctcccggagctccggcggcggctccaccggcgaaagagatcccggaggtcctagtggacccacgcagccggcggcgctatgtgcggggccgctttttgggcaagggcggctttgccaagtgct

SEQ ID NO: 1035 - DNA, 255 bp, Homo sapiens
agctggacgagcggcagcagctgggcgagtgacagccccggctccgcgcgccgcggccgccagagccggcgcaggggaagcgcccgcggccccgggtgcagcagcggccgccgcctcccgcgcctccccggcccgcagcccgcggtcccgcggccccggggccggcacctctcgggctccggctccccgcgcgcaagatggctgacccggctgcggggccgccgccgagcgagggcgaggagagcaccgtgcgct

SEQ ID NO: 1036 - DNA, 255 bp, Homo sapiens
ctcttcctccccactctgcacatgcggctgggtggcagccagcggcctcagacagacccactggcgtctctctgctgagtgaccgtaagctcggcgtctggccctctgcctgcctctccctgagtgtggctgacagccacgcagctgtgtctgtctgtctgcggcccgtgcatccctgctgcggccgcctggtaccttccttgccgtctctttcctctgtctgctgctctgtgggacacctgcctggaggcccag

SEQ ID NO: 1037 - DNA, 255 bp, Homo sapiens
tttccacatgtgaggggctgaggggctcaaggaggggagcatctccactgggtggaggctgggggtcccagcaggaagtggtgagacaaagggcgctggctggcagggagacagcacaggaaggtcctagagcttcctcagtgcagctggactctcctggagaccttcacacaccctgacatctgggccttgcccgacgagggtgctttcactggtctgcaccatggcccaggccctgggattttgaacagctcc

SEQ ID NO: 1038 - DNA, 255 bp, Homo sapiens
agccgcgagaccccctccccttccgcctcgcggcgcttcctcgcgccgcggtcttctctctccacccccgacaccgcggggctccccccgcccgcccacggcgggccccggctgcccgatccccctcgcttcccgcgctctccagcggggccccagccccggccccctctctccctcccttctctctaattccccttccggacgctgccatcatgttgaagcctcagccgctacaacagccctcccagccccagc

SEQ ID NO: 1039 - DNA, 255 bp, Homo sapiens
caggcgggcgggagggcgggcacggagaggcgggcgccgaggaggggcaggtagggctgggacgcaggggtaactggatcccccgacttcagcccaggccctggtctgaccaccctgggagcagggactttccacagtcagctggacgcacactcagcccagtaaaagaggggacccatcccgggagccccggggagggcacagctgcctcctcccgggctcccctgccacctggtgcctacctgccccctgctc

SEQ ID NO: 1040 - DNA, 255 bp, Homo sapiens
gcaccggggaattcgaatgggagaggcgggcccaaggagggagtggaatggccgcgggcggctcgacgcagcagaggcgacgcgagatggcggcagcttcagcggcggcgatctcagcaaatacttcttgagggcctactctgcgccaggtgttggggttagaaaggagctggtcgctgtcggctaagcaagattggagctactcgtcgtccacctccagctcgcgtaagggtggctgtgcgactgcggccattt

SEQ ID NO: 1041 - DNA, 255 bp, Homo sapiens
ctccctcccgccggccggggtgcgcgggcggcggggcggcccgcgggccatgcgttcggcgcggcccagcccggccggccgggggcggcgccccgagcccgggccccgcgcggcccgcgcccccggcccccgctgagccccgggggccccgctgcggccgaggccatgttcccggtgtttccttgcacgctgctggccccccccttccccgtgctgggcctggactcccggggggtgggcggcctcatgaactcc

SEQ ID NO: 1042 - DNA, 255 bp, Homo sapiens
gtaatcctgaggcctcagaacacaggtttcagattgataggcctgcaggtctccaggcagcaaccagctgagcgactaaagggcccaaggccagggctctagggatggggctcagcagaggctggggtaaggggagccagggaggagctgggcctaatgcagcaccgggtccccaggatgccgtgtctcggctggaggaggagatgcggaagctccaggccacggtgcaggagctccagaagcgcttggacaggc

SEQ ID NO: 1043 - DNA, 255 bp, Homo sapiens
acacctccctccccgcctgccagtgtcaccagcctgttgcctctgtgagaaagtaccactgtaagaggccaaagggcatgatcattttcctctttcaccctgtctaggttgccagcaaatcccacgggcctcctgacgctgcccctggggccacaggtccctcgagtgctggaaggatgaaggattcctgcatcactgtgatggccatggcgctgctgtctgggttctttttcttcgcgccggcctcgagctaca

SEQ ID NO: 1044 - DNA, 255 bp, Homo sapiens
gtgtcggacggcatgacaggcagcaatcctgtgtcccctgcctcatccagttccccagcctctagtggggcaggcggcatctccccgcagcacatagctcaagattcctcactggatggacctccaggccccccagatggtgccacagtgcccctggaggggttcagcttatcccaggctgctgacctggctaacaagggcccgaagtgggagaagagccatgccgaaattgcagaacaggccaagcatgaggcc

SEQ ID NO: 1045 - DNA, 255 bp, Homo sapiens
agtaacaataggaagtgtccgtagagctgggagtagactcctggctcatgccagctgcgccctcttttctctacctccttcctcttccccccttctcctttccctctttcccttccctcccacctcccgggaaccctggctgagtgtgcgtgtgtgggagcgcgagagccccccgacagccaccccttggggcgcgcggctgcagttagggccttggcccctccaccagaggaaggtgctgccacgtgtctgctc

SEQ ID NO: 1046 - DNA, 255 bp, Homo sapiens
tggccttttcctctcccaggtgcgcttccctgcttgatctgtgtaccctgctctttctccttcattccgcagcctcctttgccctgtgacctgcaggtactggacggtccctagagaggataccgggacgctcctgaagccgcgagatgatttcaagcagatgcagcctgaccattagggccaaggccaaattgcaaaaaaaaaaagaagtttgcctttattctactccatccacatctaaactttggaggtcaa

SEQ ID NO: 1047 - DNA, 255 bp, Homo sapiens
ggggcagcggggagcggttagaggtgggagttggcgctgcgggccgggcgggggccgcggaagctgcgatgcggacagggcagcggcggtgacccgagctgccgcccgacatgaactcgctggagcaggcggaagccccgcgagttgtatccctgattcctgcggtggtttccggtaactgccaagatctcaaggcttttgagaggagacttactgaatatattcattgtttgcaacctgctactggacgctgga

SEQ ID NO: 1048 - DNA, 255 bp, Homo sapiens
gcctggggcgtgtcacagccgaaggggcagggcggcagcagcaggcgtctaagtaacttcagcgcctgcgcagaggctccccagcgtcgccctaggctgggactctagtaggtcttcggctcagttttggctgcagcgcccgcgtagatcgcttcggccgggttctacgcccggctcaactatgagccggtgcgcccaggcggcggaagtggcggccacagtgccaggtgccggcgtcgggaacgtggggctgcg

SEQ ID NO: 1049 - DNA, 255 bp, Homo sapiens
atatacgggctccaggctgaacggctcgggccacttacacaccactgcctgataaccatgctggctgccacagtcctgaccctggccctgctgggcaatgcccatgcctgctccaaaggcacctcgcacgaggcaggcatcgtgtgccgcatcaccaagcctgccctcctggtgttgaaccacgagactgccaaggtgatccagaccgccttccagcgagccagctacccagatatcacgggcgagaaggccatg

SEQ ID NO: 1050 - DNA, 255 bp, Homo sapiens
atgcgcgcaagagagcgggaagccgagctgggcgagaagtaggggagggcggtgctccgccgcggtggcggttgctatcgcttcgcagaacctactcaggcagccagctgagaagagttgagggaaagtgctgctgctgggtctgcagacgcgatggataacgtgcagccgaaaataaaacatcgccccttctgcttcagtgtgaaaggccacgtgaagatgctgcggctggcactaactgtgacatctatgacc

SEQ ID NO: 1051 - DNA, 255 bp, Homo sapiens
ggttcccaggggagagccagccgctgccgcggcactggttcagacggccaggccctagggacccaccatggatcctgaacacgccaaacctgagtcatccgaggcaccttcagggaacttgaaacaaccggagactgccgcagccctggcaagtagcggcagcgtagtgagttctgtacccaaggcacagcgcaacatctcagcgaagaccgcaccccggaagcaccccgcagtctcaattcgcagtgcgcagtc

SEQ ID NO: 1052 - DNA, 255 bp, Homo sapiens
cgacttcggtctgcgccggaagtgcatgagctgccgatgtggtgcttagtgattgcggtttcggtcgctctcccgtgtttcccgggctgggtatttgcctcgcaccatggcgcccaagggcaaagtgggcacgagagggaagaagcagatatttgaagagaacagagagactctgaagttctacctgcggatcatactgggggccaatgccatttactgccttgtgacgttggtcttcttttactcatctgcctc

SEQ ID NO: 1053 - DNA, 255 bp, Homo sapiens
cccatgctgccctgcgccaacccctcccctcacctttcctcccccgccctctactcgccgcccggccggtccccccacccgtcccttcccttatcagcacccgcggccccggcagcgccgacgcaggcgcactgcaccgcgccgccgccattttgtgtctgagcctgtggagcgattaaaccgtgcgcggagctgcttctttggcggcagcggcggcggcggtggccggtgcggacgcgcggagctcgccggaga

SEQ ID NO: 1054 - DNA, 255 bp, Homo sapiens
cggcgtccccggggcccactcccgagcgcaggcgggcagccaggcgggcggcgcggcgcgggccggcaggaagcgtattctgggcacggggcgccgggcgggccggctgcgccgagcggcagtggtgggataccacccaaggcctcgcgcggcgccgcccgtcgaggggcgggcggcggcgtagccactgggccgtcgaagagcgcaggaggccggtgggccgggccgggccgcgcggcgcagccatgcctggct

SEQ ID NO: 1055 - DNA, 255 bp, Homo sapiens
ggaagggacagtcggccgcagaccgcgctgggttgccgctgccgctgccgccatcgtgccagcccctcgggtctccgtgaggccgggtgacgctccagaatgggagacaagccaatttgggagcagattggatccagcttcattcaacattactaccagttatttgataatgatagaacccaactaggcgcaatttacattgacgcgtcatgccttacgtgggaaggacaacagttccaggggaaagctgccatt

SEQ ID NO: 1056 - DNA, 255 bp, Homo sapiens
tttcttctccggccctggcaggttccgggagcctcggctcgtgggtgccggaagtggaggcggttggtggggttggcggggctcagcgacgctgcgcgggtggcggtttgcgaactgcgggtggactgtgtagtgaccggcgtcccgctgtctcgccccgtggcgggtgagcgagggtgcgtggtgcgcggcggcggcggaacgaacgcggtgcgggcggggcgcccgccgcagggcccatggcctcctgcgcga

SEQ ID NO: 1057 - DNA, 255 bp, Homo sapiens
ctgagctgccgcggcggcggcggcgcgaccgagcatcctggcggcgccgggccactgggagagtttatgtggccgaggcagacaagtggaattaggccttgctgcaggggacttcatttccttctcagtactggacccatttatgaggaggtggcttatgaaagtgtgatgttcgcgtatttcttgacaggcagtggcgtgatcttggctcactgcaacctccgactccctggttcaagcgattctcctgcctca

SEQ ID NO: 1058 - DNA, 255 bp, Homo sapiens
gctgagtctgagggaggctccggacccgagagccgcgagagccgccgccgctgcggccgccgccagatctgcggccgggagcccgggctgtgaggagccgggaggagcggggtgcgctgccgggcgctgaccgccctcccgcccgccgtcagaggtctgcggtgacagctcttcttcagagagaaggacaacaaggtcccagtggcccctcctcagggtctgcagtaggcctccgcatggcccaccgaggtgaac

SEQ ID NO: 1059 - DNA, 255 bp, Homo sapiens
gccgaggctgcctgactggaatgagggtagctgcggcgactgcggcggctggagcggggccggccatggcggtgtggacgcgggccaccaaagcggggctggtggagctgctcctgagggagcgctgggtccgagtggtggccgagctgagcggggagagcctgagcctgacgggcgacgccgccgcggccgagctggagcccgctctgggacccgcggccgccgccttcaacggcctcccaaacggcggcggcg

SEQ ID NO: 1060 - DNA, 255 bp, Homo sapiens
cctgcccgcgcaccgcgctcagcgcccaccgccgggcttcccgcgccggacccagtacctcggctccccggggccggaccgaggccgcaagcagcgccgcggggtgtggggcggacccaggagatgaaatgacaacgtcaaccctccagaaagccattgatctggtgacgaaagccacagaggaggacaaagccaagaactacgaggaggcgctgcggctgtaccagcatgcggtggagtacttcctccacgcta

SEQ ID NO: 1061 - DNA, 255 bp, Homo sapiens
cgaggttagggcccgcgttgcgacgtggtgcagcgcatattttcacaagtgggtctcccttgtccgggactatggccaccgactcgtgggccctggcggtggacgagcaggaagcggctgtcaagtcgatgaccaatttgcagatcaaggaagagaaagtcaaagcagataccaatggtattatcaaaaccagtaccactgccgagaaaacagatgaagaggagaaagaggacagagctgcccagtccttactca

SEQ ID NO: 1062 - DNA, 255 bp, Homo sapiens
gttaaagctgttactttcacagcttcctgggagcgagtgctttctcaagcccgtcttgcaaggtgggtccttttttgtttttggcagaagggagggacagtgaaatgtgctctgagtagggacggttatgcaaaagcaagtaggaggaggaagccaagaggggagttggtgagtcagaggagaaaagcgcatggcccggctagcagtgagcctctcaaaagcagcagggaagcccaagccacaaggtcttccact

SEQ ID NO: 1063 - DNA, 255 bp, Homo sapiens
agatgccccacagcactgctcttccagaggcaagaccaaccaagatgagtgccctgggagctgtcattgccctcctgctctggggacagctttttgcagtggactcaggcaatgatgtcacggatatcgcagatgacggctgcccgaagccccccgagattgcacatggctatgtggagcactcggttcgctaccagtgtaagaactactacaaactgcgcacagaaggagatggagtatacaccttaaatgata

SEQ ID NO: 1064 - DNA, 255 bp, Homo sapiens
agtagcgagcgccggcggcggagggcgtgagcggcgctgagtgacccgagtcgggacgcgggctgcgcgcgcgggaccccggagcccaaacccggggcaggcgggcagctgtgcccgggcggcacggccagcttcctgatttctcccgattccttccttctccctggagcggccgacaatgtccaccacggtcaatgtagattcccttgcggaatatgagaagagccagatcaagagagccctggagctggggac

SEQ ID NO: 1065 - DNA, 255 bp, Homo sapiens
tcctggcggagccatggctgcgcagcgggctggccgggggtctcctgaacccgggccccgccgccccgaccgcccggccccgccgccggggctgtccccgccgcgtccgtagcgcgtcctgccagggctgaaatctctttaatgatggagggaagcaggcagacgcgagtgtctcggccatacaagatcagcgaatcatcaaaggtataccgctgggccgaccactcaagcacggtgctgcagcggctgaacgag

SEQ ID NO: 1066 - DNA, 255 bp, Homo sapiens
aggtgtttcttggccggggccccggaagctccacctccccagcgggcccgagctgccgccgccgagcagccccgggtgagataagcagtttagacaaacactgggcgacggtggctccagcatgtatcagccgaggtggagctgcggggccctggcatgaaaggcatgagccatgagcccaagtccccttcgctagggatgctttccaccgcgaccaggaccaccgccaccgtcaaccccctcaccccctcgccg

SEQ ID NO: 1067 - DNA, 255 bp, Homo sapiens
ctttctcagcctccttagtagctgggattacaggcatgtgccaccataccctgctaattttcgtatttttagtagagatggggttttgccacattggccaggctgacaggtgatccacccgccttggccttccaaagtgctgggatgacagatgtgaccaaaagccagccccactgtgagttgaactctttcgtgttgaccggccactctccgtgctctggatgatgtcggaacacgacctggccgatgtggttc

SEQ ID NO: 1068 - DNA, 255 bp, Homo sapiens
gcgtgaccagcggcgggtcacgtgacgcggtgcctggcgccgagcctcccaagatggcggtgtgcatcgcggtgattgccaaggagaattaccccctctacattcgcagcacccctacggagaacgagctgaagttccactacatggtgcacacatctctggacgtggtggatgagaagatctccgcaatggggaaggccctggtcgaccagagggagctgtacctgggcctgctctaccccacggaggactaca

SEQ ID NO: 1069 - DNA, 255 bp, Homo sapiens
aggcgcggctttcaggccaacatggccgtgctgctgctgctgctccgtgccctccgccggggtccaggcccgggtcctcggccgctgtggggcccaggcccggcctggagtccagggttccccgccaggcccgggagggggcggccgtacatggccagcaggcctccgggggacctcgccgaggctggaggccgagctctgcagagcttacaattgagactgctaacccctacctttgaagggatcaacggattg

SEQ ID NO: 1070 - DNA, 255 bp, Homo sapiens
gcgtctgcgcctgcgcgcaagagaggcggggccagcgctcggcatggcggagccagatctggagtgcgagcagatccgtctgaagtgtattcgtaaggagggcttcttcacggtgcctccggaacacaggatcgggcccgggacacccagacagatgagattgtcgcactgaagaaggtgcggatggacaaggagaaggatggcatccccatcagcagcttgcgggagatcacgctgctgctccgcctgcgtcat

SEQ ID NO: 1071 - DNA, 255 bp, Homo sapiens
cgaagagtgcgcaggcgcgccgacagccgagttttctgcgcttccttctccctctctccagacgtcgtggtcgttcggtcctatgtcgcgccgggccctccggaggctgaggggggaacagcgcggccaggagcccctcgggcccggcgccttgcatttcgatctccgtgatgacgatgacgcggaagaagaagggcccaagcgggagcttggtgtccggcgtcccgggggcgcagggaaggagggcgtccgagt

SEQ ID NO: 1072 - DNA, 255 bp, Homo sapiens
tctcccattgcgcatgcgcgcgcccgggcggcgcgggatctgggtctggggatgtggtaccggctgctggcggcggccggcagtagagcggtggccaggccgctggccttgctgtggcgatgtggtggcccaggaggcggcaggacggccaagaccagcgcgagggccctgggcaaggcccgacagtggttatggccagtgagaatgtgcggtgttgcattgcagaagaagctaggaaagctcatctggcctcct

SEQ ID NO: 1073 - DNA, 255 bp, Homo sapiens
gaaagagccgagtgggctcgaggccgacgcgaccatcgtttgtcgacgccgctgccaccgcctgcctgagagaagtcgtcgcggccgaccccgtcgcctccgccggctaccatgtccgcccaggcgcagatgcgggccctgctggaccagctcatgggcacggctcgggacggagacgaaaccagacagagggtcaagtttacagatgaccgtgtctgcaagagtcaccttctggactgctgcccccatgacatc

SEQ ID NO: 1074 - DNA, 255 bp, Homo sapiens
tctggctcgggctctggctcgggaggcgatcgtggccgctgccgccgccagagccggccggagtcggcccggagccgcgtccacgcggagcgggcgggtgggagctggcggctgggcccctgcggcgcccccgcggcctgccccgcgtccgcctccgggccgccgagccgcagccgccgagatgggggccgccccgggccgcgcccccgccgggtcccgcccgccgcgctgccgctgagcgcatgggcccggacc

SEQ ID NO: 1075 - DNA, 255 bp, Homo sapiens
acttccggggtccgtcccggttcccggccgttgccacgacgacgaagctgccggccaatggctggcggatgggcccaaggttcccggcgtgcagcgcggctgcctgagggcggcaggctcatggcgccggcgtcgcggttgctcgcgctctgggcgctggcggctgtggctctacccggctccggggcggagggcgacggcgggtggcgcccgggcgggccgggggccgtggcggaggaggagcgctgcacggtg

SEQ ID NO: 1076 - DNA, 255 bp, Homo sapiens
gcacatgcgccctgacagcccaacaatggcggcgcccgcggagtcgctgaggaggcggaagactgggtactcggatccggagcctgagtcgccgcccgcgccggggcgtggccccgcaggctctccggcccatctccacacgggcaccttctggctgacccggatcgtgctcctgaaggccctagccttcgtgtacttcgtggcattcctggtggctttccatcagaacaagcagctcatcggtgacagggggct

SEQ ID NO: 1077 - DNA, 255 bp, Homo sapiens
tttgaatccccggcggcggcgcggggcggccgcggaccgtgagtcagcattggcggcggccccagcgcgtggcagccgtgcgccgccaaggtgcgggtctcgttactcggcggtcaggagcgggccctcccttaggtgcgccccccgccaggttctgcgttagacctgcatcttagcaatgtgaatattgcatccctagagaaggacctggaagagcaagacggccacgacctgggagcagcaggtcccaggtcg

SEQ ID NO: 1078 - DNA, 255 bp, Homo sapiens
gcatgcgcgctgcattgttttgactgaaaatgccgtcggtttcgaaagcggcggcagcggcgctgagcgggtcccccccgcagactgagaagccgacccactacaggtacctgaaggagttcaggacggagcagtgccccctgttttcacagcacaagtgcgcgcagcaccggccgttcacctgcttccactggcacttcctcaaccagcggcgccgcaggcccctccgcaggcgcgacggcaccttcaactaca

SEQ ID NO: 1079 - DNA, 255 bp, Homo sapiens
gtcgctcatcacgtggccccgtcgcgcgtcacgtggccgccggcgcgggtcacgagaacaaacacgggggcagccggcgcttcccggccggtgtcgctccgcggcgggccatggccaacgtctctaagaaggtgtcctggtccggccgggaccgggacgacgaggaggcggcgccgctgctgcggaggacggcgcggcccggcggggggacgccgctgctgaacggggctgggcctggggctgcgcgccaggata

SEQ ID NO: 1080 - DNA, 255 bp, Homo sapiens
gctgaggacgcggacccgccatggcgcggaagaaggtgcgtccgcggctgatcgcggagctggcccgccgcgtgcgcgccctgcgggagcaactgaacaggccgcgcgactcccagctctacgcggtggactacgagaccttgacgcggccgttctctggacgccggctgccggtccgggcctgggccgacgtgcgccgcgagagccgcctcttgcagctgctcggccgcctcccgctcttcggcctgggccgcc

SEQ ID NO: 1081 - DNA, 255 bp, Homo sapiens
ggaaaggggcggggcacgggcgcgttaacaccctccgcgccggaggacgagcctcggtcatcgcgctgccctcccaggttcaacaggctacccatgtgcccgctccagtaagcgtgcaaccagcccggtcagtcccagggactttaccggctaggagacaccttgaacgtccccagcgcgactcccacaaactgccttgactctttaacgcttcctcgctggcgcccattgggccaggcgtttacgtcatcgctg

SEQ ID NO: 1082 - DNA, 255 bp, Homo sapiens
acagccggtgggctcggtggggctgcagaaggtcggggctgcactgctctcggcccccacacggttggttggttggcgtggtaagtgccctgatccctggtcctgagaactcaggctggcacagggattcccagggcatctaccaccacgcagctggagcagggctgagcccaggagcatggagatggacgcccccaggccccccagtcttgctgtccctggagcagcatcgaggcccgggagaactgtggacaa

SEQ ID NO: 1083 - DNA, 255 bp, Homo sapiens
gaggaagccccgccccgcgcagccccgtcccgccccttcccatcgtgtacggtcccgcgtggctgcgcgcggcgctctgggagtacgacatggcgcgcgagctgcgggcgctgctgctgtggggccgccgcctgcggcctttgctgcgggcgccggcgctggcggccgtgccgggaggaaaaccaattctgtgtcctcggaggaccacagcccagttgggccccaggcgaaacccagcctggagcttgcaggcag

SEQ ID NO: 1084 - DNA, 255 bp, Homo sapiens
gcggccgcggcgggagcggcggcgcactcggggggaagcaggccccactagacgggccgcgccgacgggctccgcgcactcgcagcccggggcgcccccacccccagcgcccgccgccgcgggcagggccggcccggagcgcggggggcggccggggagcgcgagccgggggcgcccgccgaagctcgctgctccgggtcggggtccgggcccggggccggccgcgcgccgcctttgacgcatcggagcgcggct

SEQ ID NO: 1085 - DNA, 255 bp, Homo sapiens
gaagaggtagatagtgctggaaggcgtgctaggtacaccgcaaagactccacagcaaatcctgcacacaaaatcgcgaatgctgcagccgagaccccacgcaagcaagcaccgcaggagacgtgggctgacagctgcgccccacgtgacctcccacccgcgccagtccgtcccctcggtatcagggcgtggcctcgcggggcggccgtacctggattggccgggaggcgggaccggtggtgcgcgcgcgaaagga

SEQ ID NO: 1086 - DNA, 255 bp, Homo sapiens
acagcaatcaaatcagtgactgccagggactgggaggtgggggtgatagatatattctacttcttaaaaaaaaaaaatcaaagtatatatcctaaaacagtgattttactgtatgtaaattacactcccagaaaccttttttttaattaagtattatttcaaaattctgtttttggacaaaaccaagagccattccaaaacgttcaagaccgtcagcactgatagatgttgaagcaatttactcagtcacaattt

SEQ ID NO: 1087 - DNA, 255 bp, Homo sapiens
gtcgctcttttgttggtctggctgacttctgttcctcttttaaaaatttaagtttggccgggtgcggtggctcacggggcccctgattgtctgaaggttgcgctggcacgcgcaacttccgggacagaggctgtggctggaaggagctgggcatccggcctgaggcgcagcggtcgcgttagttcggcccaatggcggcaccgctgcttcacacgcgtttgccgggagatgcggccgcttcgccctctgcagtca

SEQ ID NO: 1088 - DNA, 255 bp, Homo sapiens
gcggccgcgggagctgcggggagcgcgggggcggcccggagcgtgccggggtccccgcgcctcgctcgccggccgcgctccgaagatggtggcggcgccgtgcgcccggaggctggcccggcgctcgcactcggcgctgctcgcggcgctcacggtgctgctgctgcagacgctggtcgtgtggaatttcagcagcctcgactccggggccggggagcgccgcgggggcgcagcggtcggcggcggggagcagcc

SEQ ID NO: 1089 - DNA, 255 bp, Homo sapiens
tttctggaaacgacggcggcccggcgggtccaaaccacctaccatccccgctcgcgtttccaggctccctacccccgccgccgccgcctcttcttccaccactgccaccgcctcctcttcatctgcggcccaccggcggcggccgccccgaagccccgccccctccatcgcctcctgcatcatcacttccggtaaccccgccggccgccagctccaggagggagaatgggagaggggcaaggagggaacgagtgg

SEQ ID NO: 1090 - DNA, 255 bp, Homo sapiens
ccttctgaaaaaagaaagccaactttcctttcaaatacacaccccaacccgccccggcatacacagaaatggggactgcgagcagaagcaacatcgctcgccatctgcaaaccaatctcattctattttgtgtcggtgctgtgggcgcctgtactctctctgtcacacaaccgtggtacctagaagtggactacactcatgaggccgtcaccataaagtgtaccttctccgcaaccggatgcccttctgagcaac

SEQ ID NO: 1091 - DNA, 255 bp, Homo sapiens
agtgccaccgccgggagccccgggtctcggcttcagccccgggctgaacaagcagggaggggagaggcacttaggcctcgcctccccgcggccttcctcccccagccggggcggaggagacccaggaagctgggcccggctcccgggggtggagggcctaggcctcggcccgcccgaggcggagcccgggaggtcggggcggggtcccgggccggtcacccacctgggttgccagtcattccagctccgcgaata

SEQ ID NO: 1092 - DNA, 255 bp, Homo sapiens
gcgagggtcattcccagccgcaaactgagtgcgctgagcggggaagcgcaaaggggcaagttacccgtcctggcgtttctggggttcgcctcggaggctagcctcggtgctctcgcaggctcgctcgcttctgcatccccgttgccgcccggagccaactcttaagttctggacgccaggcctgaggcagttccgccatggacttctccaagttcctggcagacgacttcgacgtgaaggagtggatcaatgcgg

SEQ ID NO: 1093 - DNA, 255 bp, Homo sapiens
gcagtcagcagaggagagcgccaggacgctacagcggctgaagaggcagtggcgcccgcggccgcagcgtcggggctggagcgatggcggcgaccgcggtggcggcggctgtggcgggaaccgagtcggcccagggtcccccgggcccggcagcgtcgctggagctgtggctcaacaaagccacagacccaagcatgtcggaacaggattggtcagctatccagaatttctgtgagcaggtgaacactgacccca

SEQ ID NO: 1094 - DNA, 255 bp, Homo sapiens
gttcgcgttcgccccgcctcaaaggaagaagagtccaccttgcgaccgtatccgctagcgcggcctgggatgcgcttgggctccctgttcgttcccacatgcagggcagcacaaggagaatgggcgtcatgactgatgtccaccggcgcttcctccagttgctgatgacccatggcgtgctagaggaatgggacgtgaagcgcttgcagacgcactgctacaaggtccatgaccgcaatgccaccgtagataagt

SEQ ID NO: 1095 - DNA, 255 bp, Homo sapiens
cgttgcgcatgcgccccgggcgccgccgactgaagtagcaatggacgcgctggagtcgttgttggacgaagtcgctctggaggggctcgatggcctgtgtctgccagcgctgtggagccggctggagacgcgagtgccgcccttcccgctgcctttggaaccctgcacgcaggagtttctctggcgggccctcgccacgcacccgggcatcagcttctatgaggagcctcgggagcgacccgacctacagctcca

SEQ ID NO: 1096 - DNA, 255 bp, Homo sapiens
cgcgactacgctcataaaaggaaaaaaaagcgtgtgcggttctcgacgtgccgccaatcttcgaacgcaggtctgtgatcatccgcagactccgaaaaagggttcgaggaacgcgcctgctcccctcgtcgcagtttccagcccgacgagcttgttttgtcccggactcggtgcccctgtagacaatggccctcgtgtctgccgattcccgcattgcagaacttctcacagagctccatcagctgatcaaacaaa

SEQ ID NO: 1097 - DNA, 255 bp, Homo sapiens
ctctacgtctgagaggcggaccgccctgcaccctccaagcctgcacctcttagtccagcaccaggaagagtggctctaggagggagaggagcccagggactgacccaagatgccgttgactccagagccgccctctgggcgcgtggaggggccccccgcatgggaagcagccccatggccctcactgccctgtgggccctgcatccccatcatgctggtcctggccaccctggctgcgctcttcatcctcaccac

SEQ ID NO: 1098 - DNA, 255 bp, Homo sapiens
ctgcccggcgccggcttccgggtggtgcgagcgagatggggcggagggccggtcttgcagagtagctgcggtgagtgggcgtgtgcgccgagcggtctggcccaagggctgggggccggccgagggtcttcgggagcaggccgcagggcgcggagagatcctgggatcgccgtccgccgctgctacccggcatgtcggcggaggcctcgggcccggctgccgccgcggccccgtccctggaagcccccaagccct

SEQ ID NO: 1099 - DNA, 255 bp, Homo sapiens
ccctgctaacaaagggagccacttccttcctctctgcacataccccatgtctcaccacgatgatggagctacagtgggacttggaatccagatgtgtgaaggatggagggttgaagccgcactcagcttcctgccccaccagaggaagtggggagagacggcaggtgcagtgatggctggcggagtcatggacaaggagtacgtgggttttgctgccctccccaaccagctgcaccgcaagtctgtcaagaaggg

SEQ ID NO: 1100 - DNA, 255 bp, Homo sapiens
ggtcgcgctgccgccgttttatttgaagacatcgtccagttctgaccatggactcgcagccatcggcccttagtttccatcccctctagtgggccttcgggggctctactgacgtccctccttcccttggtaccgggccggggaagtgttctcgggcgcgggaggttccgcatgcccaggcctggccaggggagatgaccgatccgtcgctggggctgacagtccccatggcgccgcctctggccccgctccctc

SEQ ID NO: 1101 - DNA, 255 bp, Homo sapiens
ggggcagatcctggggagaatggaggagcacacagaggcaggctcggcaccagagatgggggcccagaaggccctgattgacaatcctgctgacatcctagtcattgctgcatatttcctgctggtcattggcgttggcttgtggtccatgtgcagaaccaacagaggcactgtgggcggctacttcctggcaggacgcagcatggtgtggtggccggttggggcctctctcttcgccagcaacatcggcagtgg

SEQ ID NO: 1102 - DNA, 255 bp, Homo sapiens
ggggctttgcggctgtcgtcaagcgcggcgttgggccggcgggcgggggctgaggggctgccatggcggcggcgggccggctcccgagctcctgggccctcttctcgccgctcctcgcagggcttgcactactgggagtcgggccggtcccagcgcgggcgctgcacaacgtcacggccgagctctttggggccgaggcctggggcacccttgcggctttcggggacctcaactccgacaagcagacggatctct

SEQ ID NO: 1103 - DNA, 255 bp, Homo sapiens
gtgtatttgaataaaccaggttggcaaatcatactatagctgaaagaattggcaggaactgaaaatgactaggaagaggacatactgggtgcccaactcttctggtggcctcgtgaatcgtggcatcgacataggcgatgacatggtttcaggacttatttataaaacctatactctccaagatggcccctggagtcagcaagagagaaatcctgaggctccagggagggcagctgtcccaccgtgggggaagta

SEQ ID NO: 1104 - DNA, 255 bp, Homo sapiens
ttccggcgtgcctacgcctcctcttgcgctgtcctgttaatggcgggcagtagccgctgaggggattgcagataaccgcttcccgcacggggaaagtctaccctgcctgccactttctgctcgccgtcagcgccggagctcgccagcatgtctgtggtaccgcccaatcgctcgcagaccggctggccccggggggtcactcagttcggcaacaagtacatccagcagacgaagcccctcaccctggagcgcacc

SEQ ID NO: 1105 - DNA, 255 bp, Homo sapiens
agggccgggaaacacgataaaggggacatgccgggagttgcagtaccctcaggaaggtagcgtcttgatctgcgtggcgtggttctgtgccttgggaagagatgaatgggaagcggccagcggagcccggcccagcccgggtgggaaaaaagggaaagaaggaggtgatggcggagttttcggacgctgttacggaagaaaccttgaaaaagcaggtggctgaggcctggagccgcaggacgccgttcagtcacg

SEQ ID NO: 1106 - DNA, 255 bp, Homo sapiens
gcggccgcccgccgccgcgctcctcctcctcctcctccagcgcccggcggcccgctgcctcctccgcccgacgccccgcgtcccccgccgcgccgccgccgccaccctctgcgccccgcgccgccccccggtcccgcccgccatgcccggcccggccgcgggcagcagggcccgggtctacgccgaggtgaacagtctgaggagccgcgagtactgggactacgaggctcacgtcccgagctggggtaatcaaga

SEQ ID NO: 1107 - DNA, 255 bp, Homo sapiens
tctggcccagggaagtccctgtccttaccttcagcaggagccggttccctgtgtgtgtgtccgctcgccctctgctccgtcctgcggctgcccactgccctcctacggtccaccatggccctgctgcactccggccgcgtcctccccgggatcgccgccgccttccacccgggcctcgccgccgcggcctctgccagagccagctcctggtggacccatgtggaaatgggacctccagatcccattctgggagtc

SEQ ID NO: 1108 - DNA, 255 bp, Homo sapiens
aagtgcgcgggttggagcggaagcgcacgcctgctaggatcagcggtggtggttccgcgatggtaggcggcggcggggtcggcggcggcctcctggagaatgccaaccccctcatctaccagcgctctggggagcggcctgtgacggcaggcgaggaggacgagcaggttcccgacagcatcgacgcacgcgagatcttcgatatccgccgctgctgggcgcgggcgggttccgggggcttgcggtggggggagc

SEQ ID NO: 1109 - DNA, 255 bp, Homo sapiens
cagccgcgtccggtccggccgggcccgaaccgcggagctacagtgtgctttgagtagaagctgcactggggccgggactcggaggcgcgctgcgtgagccggccgcagagccatggcgggcggggaagaccgcggggacggagagccggtatcagtggtgaccgtgagggtgcagtacctggaagacaccgaccccttcgcatgtgccaactttccggagccgcgccgggcccccacctgcagcctggacggggc

SEQ ID NO: 1110 - DNA, 255 bp, Homo sapiens
acttgacagcccgctgaggacgcagcgtcagctgacctggggagtcgcgattcgtgccggccggtcctggttctccggtcccgccgctcccgcagcagccatgtcgttcttcccggagctttactttaacgtggacaatggctacttggagggactggtgcgcggcctgaaggccggggtgctcagccaggccgactacctcaacctggtgcagtgcgagacgctagaggacttgaaactgcatctgcagagcac

SEQ ID NO: 1111 - DNA, 255 bp, Homo sapiens
atgcgcagtcctcctgccgtcccgcccctccctttccagagcccccagttccttagaaaccaggcggcgcgttcccggtggcggcgccctggactcccgggcccgcgcatccccgccagccttccttaaggcggatgggtggcccccgagaccccgtcggacccatggtttccagtgcagcgcggagtgggcgatgccagcgtgccaggagccatgtctgaccaggacgtttggaagatcatatccatgccagag

SEQ ID NO: 1112 - DNA, 255 bp, Homo sapiens
cccggggggcgggcggaggaagtgagcgcagcggggaggaatgcgagcgggcggggcgtgtcggcccggggcggcggggacagcggcggggacagcggcgggcggctgggacggcgggtgcggcggggccgagcccgcacgatgcctcacttcaccgtggtgccagtggacgggccgaggcgcggcgactatgacaacctcgaggggctcagttgggtggactacggggagcgcgccgagctggatgactcggac

SEQ ID NO: 1113 - DNA, 255 bp, Homo sapiens
gcttgggggcggaaaagccgtggcgcccccttgcgtggcgcgtcggtctcagagtcgcgtgacttcaaccccctcttcgggaggctgggtcgtcatgatccggaccccattgtcggcctctgcccatcgcctgctcctcccaggctcccgcggccgacccccgcgcaacatgcagcccacgggccgcgagggttcccgcgcgctcagccggcggtatctgcggcgtctgctgctcctgctactgctgctgctgct

SEQ ID NO: 1114 - DNA, 255 bp, Homo sapiens
atctctgtgccctcccccttgcaggggaaacagcacacactagtgaaatcttgtcttagtgtgtccggaattggtgggttcttggtctcactgagttctagaatgaagctgcagaccctcgcagtgagtgttacagctcttaaggctctctgactgccacccctgcctgcctgcccggccctgcacaacatgcagccctccggcctcgagggtcccggcacgtttggtcggtggcctctgctgagtctgctgctc

SEQ ID NO: 1115 - DNA, 255 bp, Homo sapiens
atagtcggaagtgcgcaggcagtgctcgcggcggcggcgacggcggcgggaggttcggttgtcgcccgttggccgcgcggcgccgcgctcggcggccgccattgcagtgcgagggctggaggcctggcagaatgggtgctgatggagctacagggggagatcgaggctcgctacagcactggattagctggaaacctcctgggagacctacattacaccactgagggaatccctgtgctgatcgtggggcatcat

SEQ ID NO: 1116 - DNA, 255 bp, Homo sapiens; identical to SEQ ID NO: 1060

SEQ ID NO: 1117 - DNA, 255 bp, Homo sapiens
ggaacgctgtttctatcatggccgcgggagccgggacggcgggccccgcttccggcccgggcgtcgtgcgtgacccagcggcgtcacagccgaggaagcggcccggccgggagggcggggagggcgcgcggcgatcggacacgatggcgggaggaggcgggagtagcgacggcagcgggcgggcagctggcaggcgggcgtcccgcagtagcgggcgggcccggcgggggcgccacgagccggggctggggggcc

SEQ ID NO: 1118 - DNA, 255 bp, Homo sapiens
ggtacagctgcgcgtctgcgggaataggtgcagcgggcccttggcgggggactctgagggaggagctggggacggcgaccctaggagagttctttggggtgactttcaagatggactctactctaacagcaagtgaaatccggcagcgatttatagatttcttcaagaggaacgagcatacgtatgttcactcgtctgccaccatcccattggatgaccccactttgctctttgccaatgcaggcatgaaccagt

SEQ ID NO: 1119 - DNA, 255 bp, Homo sapiens
cgggcggacgagagagctgcgagctaacgggtccggacgacggcggcggcggcggcggcggcggcgacggctttctgcgcgggcggcggcggcggccggagcggcgagcatggcccgcgcggcgccgggcgctgactgagggtcgtgctgcggcagcctggcgcccgacatgtgaaggggaacctgccaggggattactgtgagctcacagcaggataggctggccccgggggagtggggatgggcagaacctgg

SEQ ID NO: 1120 - DNA, 255 bp, Homo sapiens
gactcgagtaacatggccgctgtctcgtgagtcccgctagtgccgggcgggagttgttaagcggccagggtcaggtgtgctggagcggggtccgggcccgggttccagggcgaggcggcggagcgtggcaggcaagcctagagcggcgtggtccatgcgccggcgccgggggcagagcggagccgcagactcccctggccccggcgcggccccggcagccgcgggctaaggagtcgcgaggttcccccagctgcc

SEQ ID NO: 1121 - DNA, 255 bp, Homo sapiens
gctctgccaggagcagtcgcctcctccttggcaaatagtcctcggcagggtccgagttcttggataattcgagagaaaaggcacgataagttgcagtacgaggacacggaaacgaccaggagaggaggacagggagcgaagtttcctcaatagtgtgtgaagttagttaaaaactccctccttcctcaggatccctccgcctgcggtagcggtggtgaggccgagggagccgccattttggatgttcggttcctg

SEQ ID NO: 1122 - DNA, 255 bp, Homo sapiens
cggggctgattctctggctgtgtggggcgcacggtcccgggatactggggacggcggggtgggagggcgccgtcctggggccgcggcggccgggcgggggagatggcggcgcgatggagcagcgaaaacgtggttgtagagttccgtgactcccaggcaactgcgatgtctgtggactgtcttgggcagcatgcagtgctttctggccgcagattcttatacatcgtcaatctagatgcccctttcgaaggtcac

SEQ ID NO: 1123 - DNA, 255 bp, Homo sapiens
ccacaccttctgaggcagcggcatggcttccctctggctcctctcctgcttctcccttgtgggggccgcctttggctgcggggtccccgccatccaccctgtgctcagcggcctgtccaggatcgtgaatggggaggacgccgtccccggctcctggccctggcaggtgtccctgcaggacaaaaccggcttccacttctgcgggggctccctcatcagcgaggactgggtggtcaccgctgcccactgcggggt

SEQ ID NO: 1124 - DNA, 255 bp, Homo sapiens
aggaggcacttccggtccaaaccggaagaccgtgggtagctgcggcggggctgacccgtcccgagtgccaaagctggggttctacttgagatttccctcgtggtgccagggtccggcgagcatcacgccgaggcccattttccagacgaccacgacgaggccggggtcacctggcgagacgcactgactctgccagaggcccagccccagaactcagaggtgtccctgggcttacctcagcaaccgacagcgccg

SEQ ID NO: 1125 - DNA, 255 bp, Homo sapiens
cgcgctggagcgtgcgcacaggcggcagcagtggccgtcactgggcggcatggcggtgtgtgctcgcctttgcggcgtgggcccgtcgcgcggatgtcggcgccgccagcagcgccggggcccggccgagacggcggcggccgacagcgagccggacacagaccccgaggaggagcgcatcgaggctagcgccggggtcgggggcggcttgtgcgcgggcccctcgccgccgcccccgcgctgctcgctgctgga

SEQ ID NO: 1126 - DNA, 255 bp, Homo sapiens
ggcgatgagttcctgctgctgttcaccatggcctccaaccacccggccttcagcttccaccagaagcaggtgctgcgccaggagctcacgcagatccagagcagcctgaacggcggcgggggccacggcggcaagggcgcgcccgggccgggcggcgcgctgcccacttgcccagcctgccacaagatcactccaagaactgaggcccctgtcagcagtgtcagtaatagtttggagaatgccctgcacacatca

SEQ ID NO: 1127 - DNA, 255 bp, Homo sapiens
atggagccgcacgtgctcggcgcggtcctgtactggctgctgctgccctgcgcgctgctggctgcctgcctgctccgcttcagcggactctcgctggtctacctgctcttcctgctgctgctgccctggttccccggccccacccgatgcggcctccaaggtcacacaggccgcctcctgcgggcattgctgggcctcagcctgctcttcctggtggcccatctcgccctccagatctgcctgcatattgtgccc

SEQ ID NO: 1128 - DNA, 255 bp, Homo sapiens
atggcgtcacgcggcgtccagagcagaccagccgcccggcaccggcggagagcgcctccccgctcacctgtcgggccttgcccagggccctcgcgctggtcttggccgtcctgccgcctcctgggccaccacatcgccacagcaaggccagcggcctggccaccgctctactgccggccgccgccagcagccggtaccacatccccagacccagatcccgcgccgcccgggcgcgcgcatgcgcaatgggagagc

SEQ ID NO: 1129 - DNA, 255 bp, Homo sapiens
cgagggttgcttgggcagcgactgtcatggcggcggccgcccccaatgccggaggctcggcccctgagacagcgggttccgccgaagctccgctgcagtacagcctgctcctgcagtacctggtgggtgacaagcgtcagccccggctcctggagcctgggagcctgggcgggatcccaagtccagccaagagtgaggagcagaagatgatcgagaaggcgatggaaagctgcgctttcaaggctgcgctggcct

SEQ ID NO: 1130 - DNA, 255 bp, Homo sapiens
gggggcgggagcggtgcgcgcaacttctcgggccaataactgcgcagcgcgcgggacccgggtggggaagctggagctgttgcggggtccgcggggaagtcttggcggtggagccatggtcggccaactgagcgagggggccattgcggccatcatgcagaagggggatacaaacataaagcccatcctccaagtcatcaacatccgtcccattactacggggaatagtccgccgcgttatcgactgctcatgag

SEQ ID NO: 1131 - DNA, 255 bp, Homo sapiens
gtgcattgtgcttccgctcggggaaagaccgcttccggtgcttccgtcgctccttgccgggcataatggccgcgcagcgacccctgcgggtcctgtgcctggcgggcttccggcagagcgagcggggcttccgtgagaagaccggggcgctgaggaaggcgctgcggggtcgcgccgagctcgtgtgcctcagcggcccgcacccggtccccgaccccccgggccccgagggcgccagatcagacttcgggtcct

SEQ ID NO: 1132 - DNA, 255 bp, Homo sapiens
ggaagatggctgcggagccgagcaccgggcagtggctgcggcggcggcggcggcggcgggccgggagcgcggcgggcgggggctccgccttgcgcgtggggcgctgagccgagaggcgcggaggcggcgagggcgcgggggctctgaggaccgctcggcgccgcctcctgccacaccatgggcagcgcagaggacgcagtcaaagagaaactgctgtggaacgtgaagaaggaggtgaagcaaatcatggaggag

SEQ ID NO: 1133 - DNA, 255 bp, Homo sapiens
ccccgcgtgtctgctaggagagggcgggcagcgccgcggcgcgcgcgatccggctgacgcatctggccccggttccccaagaccagagcggggccgggagggagggggaagaggcgagagcgcggagggcgcgcgtgcgcattggcgcggggaggagcagggatcttggcagcgggcgaggaggctgcgagcgagccgcgaaccgagcgggcggcgggcgcgcgcaccatgggggagaaacccgggaccagggtc

SEQ ID NO: 1134 - DNA, 255 bp, Homo sapiens
tgaaggcctgtgagtgaggaatgcctctcaccagctgtgcctgagctgcagcactccagccactgctgtctccttagctgctcacatatggatactttcacagttcaggattccactgcaatgagctggtggaggaataatttctggatcatcttagctgtggccatcattgttgtctctgtgggcctgggcctcatcctgtactgtgtctgtaagtggcagcttagacgaggcaagaaatgggaaattgccaag

SEQ ID NO: 1135 - DNA, 255 bp, Homo sapiens
gttttgcctgcacgatgtccagcaaagctgagaagaagcagcgattgagtggccgaggaagctcccaggcaagctggtcagggcgggccactcgggctgctgtggccacacaggagcaggggaatgccccggctgtcagtgagccagagctgcaggctgagctccccaaggaggagcctgagccacggttggagggacctcaagcacagagtgaagaatcagtggagcccgaggcagatgtgaagcccctcttcc

SEQ ID NO: 1136 - DNA, 255 bp, Homo sapiens
ctactgcgcaggctcagtgctgcttacccatcatggaagcaatgtggctcctgtgtgtggcgttggcggtcttggcatggggcttcctctgggtttgggactcctcagaacgaatgaagagtcgggagcagggaggacggctgggagccgaaagccggaccctgctggtcatagcgcaccctgacgatgaagccatgttttttgctcccacagtgctaggcttggcccgcctaaggcactgggtgtacctgcttt

SEQ ID NO: 1137 - DNA, 255 bp, Homo sapiens
gattcgcagcagggtgtgtccagatggtcagtctctggtggctagcctgtcctgacaggggagagttaagctcccgttctccaccgtgccggctggccaggtgggctgagggtgaccgagagaccagaacctgcttgctggagcttagtgctcagagctggggagggaggttccgccgctcctctgctgtcagcgccggcagcccctcccggcttcacttcctcccgcagcccctgctactgagaagctccggga

SEQ ID NO: 1138 - DNA, 255 bp, Homo sapiens
gcggccgcgctgagcccctagcccgccgggagcgccaggccggccaggcctgcgccgccgccgccgccgccgtcgccgccgcgccgaccatgtcggcagccaaggagaacccgtgcaggaaattccaggccaacatcttcaacaagagcaagtgtcagaactgcttcaagccccgcgagtcgcatctgctcaacgacgaggacctgacgcaggcaaaacccatttatggcggttggctgctcctggctccagatg

SEQ ID NO: 1139 - DNA, 255 bp, Homo sapiens
acttggctcgcccggactctgaatcctggagcaccaggcgcccacgagaacgctgttctctttggcttccgggcgcacgctactctgtcgccgccgtcagaccggaattgccggtgccgccgccaccgctgtctgtgcgcccacctctgctgctaccatggggatcttagagaagatctcggagatcgagaaggagatcgctcggacacagaagaacaaggccactgagtatcatctgggcctgctgaaagctaa

SEQ ID NO: 1140 - DNA, 255 bp, Homo sapiens
cggacgatgccgtgacgcggcacggcgacactgttggcaatatgagcgcacccctgtagagggagcccttcggtcctggaggcggcgcggcgtgaagacaggttgctatttgagagcgttcccttgaagcccctcagagagtgggggaggggcggcggacggcaagcggttcctgtctgcgcttgcgccggcgcctctgccgacccggcctgcacgcacgcgcatgcccgtagcgcgcggagccgcggtggccgg

SEQ ID NO: 1141 - DNA, 255 bp, Homo sapiens
gtattttggcacctgtgcgctggactcgagcgctccgattggagttagggcctgcttgtctgcgtgctgcgaagtccgcggctgcccccggggccctagtcgttgggttccagggtccttcacgttccattcccaggctggtctgagctccggggccgtggtcccgctgcctcctccggtcgtcgtgcggaagctgcgacgcaggcagaccatggcagagttctcccagaaacgggggaagcggcgtagcgacga

SEQ ID NO: 1142 - DNA, 255 bp, Homo sapiens
agatatctccggcgccgcccgccattttgactccagtgtctcgtttgcagtcggcgctttaggggaactgtcttcctccgcaggcgcgaggctgggtacagggtctattgtctgtggttgactccgtactttggtctgaggccttcgggagctttcccgaggcagttagcagaagccgcagcggccgcccccgcccgtctcctctgtccctgggcccgggagggaccaacttggcgtcacgcccctcagcggtcg

SEQ ID NO: 1143 - DNA, 255 bp, Homo sapiens
cccctcctcctcctcactcctcaccctccagggtagcggctaccggagcgctgcagggggctgcgcctgcctgctccgccccagacctgtcggcgaaaggtagtttatgccaacgtgacttcattcatacagatgaaccaaggatcgggatagcagtataaaattagaatcaagacagctgactgctcagcaggatgccatcaactaacagagcaggcagcctgaaggaccctgaaattgcagagctcttcttca

SEQ ID NO: 1144 - DNA, 255 bp, Homo sapiens
atttgtgcaccttattagcctgggcagaatggctaatggtcacacttctaatacacactttaagtgttattaagcattgcatgaggtttaaaaaattacaaagtagaagaaggaggacctcaagaaattagtataaaacaagagaatgttataaatatttatgaggtttgtgctttctggaaatctgcatggtggctcagtggtagcaagctatccttttgatgattctccagaacataaggccactggaatcta

SEQ ID NO: 1145 - DNA, 255 bp, Homo sapiens
aaatttccttttgatgaagtcattgactaaagcgtcattaaaacaaaacaaaaaaagaattccaaaaaccctccaaaattcctttttaaagataggaaggcatacctgctgtcattttataggtagaacactaaaacacagtaaattacctggcctccaacttggtagtctgatttttttctgccttggtctggtgtttttgtggttttgttcttactttttgtgagttgtgaggggttttttgttgtttatttt

SEQ ID NO: 1146 - DNA, 255 bp, Homo sapiens
gggtggcgccaaggaaggaggagaaaaggcggccgagaaaaggaggagggcaaggggaagaggaagggcgagggaggagcctgaggagactcgcccggctcaaccccgacgtccgcgccccggccgcctgttggccatggcgggcctgggcctgggctccgccgttcccgtgtggctggccgaggacgacctcggctgcatcatctgccaggggctgctggactggcccgccacgctgccctgcggccacagctt

SEQ ID NO: 1147 - DNA, 255 bp, Homo sapiens
gacggaaaccagaatcgttttgggtctggtcgccaagatggcgtcctccgcctccgcccggactccggcagggaagcgagtgataaatcaggaagaattgcggcggttaatgaaggagaagcagcgtctgagcaccagtcggaaacggatagaatctccattcgcgaagtacaaccgtttggggcagctgagttgtgccctgtgtaacactccggttaagagcgagctcctgtggcagactcacgtcctgggaaa

SEQ ID NO: 1148 - DNA, 255 bp, Homo sapiens
agtccgcctcagcccgccgcgccgccctcagtacagctccggccgccgcgccgcctggctttcgtattcgttgttctcggcgggctgtggggcctccgcgccgcggccgttagtcatgtcggattctggaagttacggtcagtctgggggtgagcagcaaagttattctacctatggaaatccaggcagccaaggctatggacaagcatcacaaagctattctggctatgggcaaacgactgattcctcttatgg

SEQ ID NO: 1149 - DNA, 255 bp, Homo sapiens
accttcccctcgtcccccgccctccttcttccactccccgcggcgcgagcggctgactgcccgtagaggaaacgacattcggagctgcgctcccgcccacgccggccctgacgcgggcctcgtcagccagtaacagggagcagaggtgggagttagcgaggcgaccacgaaaacggtgaaggtcggaaccgacagcctcctccgagaagggcaggagctgggaggaggcggcagcggcggcggcagaaacagcag

SEQ ID NO: 1150 - DNA, 255 bp, Homo sapiens
gcagtcagcctgagagcgctgaggcgccagcaccgcgggccccgccgtccccccaggaacccgcccccgcgcagccccacgtcgcccggagagcgcgcctcgctgcgcgtgcccttgcccgcgcccgaggcgcgtgcccgccccagtgcagcccctcctccccgctgtgtttattaggggaaggagggcggaggcggaggccagttccccagctccagccgccgtcgctgctgcctgtgtagttgcagccgcggc

SEQ ID NO: 1151 - DNA, 255 bp, Homo sapiens
gttgactcggccatcggcctgccgggcctggcgtttcccagaaggcccagcgccgggaaggggtttgcagctgctccgtcatcgtgcggcccgacgctatctcgcgctcgtgtgcaggcccggctcggctcctggtccccggtgcgagggttaacgcgaggccccggcctcggtccccggactaggccgtgaccccgggtgccatgaagcaggagggctcggcgcggcgccgcggcgcggacaaggcgaaaccgc

SEQ ID NO: 1152 - DNA, 255 bp, Homo sapiens
gagcgcggctggagtttgctgctgccgctgtgcagtttgttcaggggcttgtggtggtgagtccgagaggctgcgtgtgagagacgtgagaaggatcctgcactgaggaggtggaaagaagaggattgctcgaggaggcctggggtctgtgaggcagcggagctgggtgaaggctgcgggttccggcgaggcctgagctgtgctgtcgtcatgcctcaaacccgatcccaggcacaggctacaatcagttttcca

SEQ ID NO: 1153 - DNA, 255 bp, Homo sapiens
gttgcggcttattgcatcacagtaattgctgtacgaaggtcagaatcgctacctattgtccaaagcagtcgtaagaagaggtcccaatcccccactctttccgccctaatggaggtctccagtttcggtaaaagtttcatttgatctgaatagtattaaaataaaatacctggatgaggaagatgaagagtagagacggggtttcactgtgttagccaggatggtctcgatcccctgacatcgtgatccgctgtc

SEQ ID NO: 1154 - DNA, 255 bp, Homo sapiens
gaagccggaagagaccggaccctgaacagaatcgcagattgccagcccttttcccgacccctacggaaagacgagtccaggggccgtcctggcgaggtcaaaacatttagtctggtcttttcagtgtgccaggcactgtgccaagtattttgcttcgatgatttcacgtcatcttcaaaacaacctcatgagcgtggaccctgccagcagccaggccatggagctctctgatgtcaccctcattgagggtgtggg

SEQ ID NO: 1155 - DNA, 255 bp, Homo sapiens
ccactcgtaggcctgggacgcgggctgccggccgagtggcctgagggcctggctgcccggggggcgggccggggccgcggccgggggcgcggagcggagctcggggcgccaggccgagccgaggtgggacggaccgacgcggagaggaagggaagccgcatcccgcggggcgcccctcctgaagcgagccgggcagcggccgcgggcgcccctgccctgagcccaccccgcgctctgccctccctaacaatggga

SEQ ID NO: 1156 - DNA, 255 bp, Homo sapiens
ggcggttgcacgcctgcgcgagggcgggcggcgggggcgcgcgcgcggcgggggcgggctttgccgagcgcagagctgcagccgccgagccggacgtgtccgcgaagatggcgggccggagcatgcaagcggcaagatgtcctacagatgaattatctttaaccaattgtgcagttgtgaatgaaaaggatttccagtctggccagcatgtgattgtgaggacctctcccaatcacaggtacacatttacactga

SEQ ID NO: 1157 - DNA, 255 bp, Homo sapiens
aaccggaaggggggctgtgaggacgtgttccgaggaagccagagccggagccgtggcctgcggggccggcgacatggatcccctgttccagcaaacgcacaagcaggtccacgagatccagtcttgcatgggacgcctggagacggcagacaagcagtctgtgcacatagtagaaaacgaaatccaagcaagcatagaccagatattcagccgtctagaacgtctggagattttgtccagcaaggagccccctaa

SEQ ID NO: 1158 - DNA, 255 bp, Homo sapiens
ggcggggccgcgcacgcagccgccgccaccacttccccctctccctccctccttgcgggccctcctccccttccctcccctccgcccccttccccgtaggcagcccgcccgccagtccgcccgcaccgcctccttcccagcccctagcgctccggctgggtctctcccccgccccccaggctcccccggtcgctctcctccggcggtcgcccgcgctcggtggatgtggctggcagctgccgccccctccctcgc

SEQ ID NO: 1159 - DNA, 255 bp, Homo sapiens
aacggccaatcgtcgtggagcgcggcgcctccgcggagaggtccggtccgaatatccctccgccttcctccctccctcgctccctccctgcgcgccgcctctcactcacagcctcccttccttctttctccctccgcctcccgagcaccagcgcgctctgagctgcccccagggtccctcccccgccgccagcagcccatttggagggaggaagtaagggaagaggagaggaaggggagccggaccgactaccca

SEQ ID NO: 1160 - DNA, 255 bp, Homo sapiens
attcggagcctggggtgggcggggcttgaggcctgagtggagcgtaaaccctgattggctgtacggaaggcggcgacgtggccgaaggatgcccgtttgtgtctaaacggaggctcggccacaacgccactggattggtggtagggcggggcgggccacagtctccagcctgaagcggaagtggaggaaagatggaggaccatcagcacgtgcccatcgacatccagaccagcaagctgctcgattggctggtgg

SEQ ID NO: 1161 - DNA, 255 bp, Homo sapiens
caggacacgtgggtgggggaagctgagcgctgagaccaagggctaaagctgggaggtgagtctgtcaccttgagccgggcgagcgctgtgggccaagcaggggttgcagggtagtaggagtgcagactgaaaaaatgcagaccgccggggcattattcatttctccagctctgatccgctgttgtaccaggggtctaatcaggcctgtgtctgcctccttcttgaatagcccagtgaattcatctaaacagcctt

SEQ ID NO: 1162 - DNA, 255 bp, Homo sapiens
agcaccgtctgggctgtggaagcggagggggtggggacactctggcccggttctcggtggtgcgggagcgggcgggagcagcggccgctctggtcggcggacgtgctgccgagtagtcccggaagcgaagcagcgatggcggagagtccgactgaggaggcggcaacggcgggcgccggggcggcgggccccggggcgagcagcgttgctggtgttgttggcgttagcggcagcggcggcgggttcgggccgcct

SEQ ID NO: 1163 - DNA, 255 bp, Homo sapiens
cccgcctccctaggcgtggaggagggggggcggctcagccccgcgcccgtgcgcgcgctcgcggccgggttgcagggctgggcgcgcgccccgcgtcccgggcaggaagatggtggcgagcgcgcgagtgcagaagctggtgcggcgctacaagctggcgattgccacggcgctggccatcctgctgctgcagggcctggtagtgtggagcttcagcggcctggaggaggacgaggcgggcgagaaaggaaggca

SEQ ID NO: 1164 - DNA, 255 bp, Homo sapiens
aaaccggtgccaacgtgcgcggacgccgccgccgccgccgccgctggagtccgccgggcagagccggccgcggagcccggagcaggcggagggaagtgcccctagaaccagctcagccagcggcgcttgcacagagcggccggacgaagagcagcgagaggaggaggggagagcggctcgtccacgcgccctgcgccgccgccggcccgggaaggcagcgaggagccggcgcctcccgcgccccgcggtcgccct

SEQ ID NO: 1165 - DNA, 255 bp, Homo sapiens
ctccagctcgcggccccgcgcgccggatcggcgtgcgtgcggctggagccttaagcgtttcccccgcccggcttcatccctgctggcggcccagcgtcgttctcctcctgcgcgaggcggccaaggcctgctggcccggagccgcgcctccacccgcgcgaggtatcgtccttggagaagatggaagcggagaggcggccggcgccgggctcgccctccgagggcctgtttgcggacgggcacctgatcttgtgg

SEQ ID NO: 1166 - DNA, 255 bp, Homo sapiens
aagggcgaggggcggggcctgcgtcgcgctgcgggcacgtcgccgcgcgtcttcagtatttaatgtctctgtgttccacccgcctgggctagcacgtgggggagctgcggaagcgcggcgctgcgggccgggccgcggggcacagccgggggccggcggcggcgcgcggactccgcatcccgcaccccgatggtagccgaggagctggtgtaattacttcaagcctccaggatggcaatccagttccgttcgctc

SEQ ID NO: 1167 - DNA, 255 bp, Homo sapiens
attcttcctcttgccacacccacagggcccgcactaagagcctaactgaaatcccgcgaggatcaaccgagctcgccgaaaggagggaggaacgtatcccttctggaggctgtctcagggggcagagggaccggaccggaagtgacgtgagcgggttccggttgtctggagcccagcggcgggtgtgagagtccgtaaggagcagcttccaggatcctgagatccggagcagccggggtcggagcggctcctcaa

SEQ ID NO: 1168 - DNA, 255 bp, Homo sapiens
agactggcgaaagtgatgagtctaaaaaagtagtccctccggttcctctgtttccccccatgtggcgtcaggaagcgaggcaccgggcgcactgcgccccgaattcctgcgcccgccgcgcgcggcgctccgtggaggggtacataaggcggagggggtgaggcgactgggcggagttctgtcgccgggatccttccgctgggctcagccgtttccggagtctgcgctgcgcccggttccgccattgcggctctc

SEQ ID NO: 1169 - DNA, 255 bp, Homo sapiens
cgctataaaacccaggccggcaggatcgctgcacccgcggcggcctcctcggtgcgcgacccccggctcagaggactctttgctgtcccgcaagatgcggatgctgctggcgctcctggccctctccgcggcgcggccatcggccagtgcagagtcacactggtgctacgaggttcaagccgagtcctccaactacccctgcttggtgccagtcaagtggggtggaaactgccagaaggaccgccagtcccccat

SEQ ID NO: 1170 - DNA, 255 bp, Homo sapiens
tgagacggctaggtcacagaagcagtgggtcagaagccagaggggacgtggggagtgccaccctggagcctaccggcacacctgctgagatggaggcctcagatgggcaagggggtgaaggggacaagccactagagcaggtgacaaatgtgtcatgcctggagacaagctccagcgccagccctgctagagactcgctcatgcgccatgccaagggcctggatcaggacaccttcaaaacttgtaaagaatacc

SEQ ID NO: 1171 - DNA, 255 bp, Homo sapiens
gttccgagagggcggggcggcgtcccaaaacggaaggtggttgtcgtccgttcccaagctggtttgaaactaggggtcgggctcggccgtcgtcgttgtttgtcgccgcatccccgcttccgggttaggccgttcctgcccgccccctcctctcctcccttcggacccatagatctcaggctcggctccccgcccgccgcagcccactgttgacccggcccgtactgcggccccgtggccaccatgtccctgcac

SEQ ID NO: 1172 - DNA, 255 bp, Homo sapiens
cccgcacccacctcccggccccaggcacactgcatcggcgcggacgctccggccccggcgaggtggctgcaaactcgcgggcacgcacggcgcccggggagccgagggactcgggggaggggacgcgcgcggaaggcgccagcttcctcccgcccgcccctggcagccgcgagccgaggttggaggcgcccggggccccagccgggcagagccgagcggcggcggcggcggcggcttcccttttctccccgagcc

SEQ ID NO: 1173 - DNA, 132 bp, Homo sapiens
cctcctacaaaggcatgtctatagttccttgtctttggacatgtaagaattggaggcaaagaaatgtggacttggagaaatctggggccagcttgctctccgcaggctcaagatcaaccatcccacatagaa

SEQ ID NO: 1174 - DNA, 255 bp, Homo sapiens
agttccaagtttggagcttttagctgccagccctggcccatcatgtagctgcagcacagccttccctaacgttgcaactgggggaaaaatcactttccagtctgttttgcaaggtgtgcatttccatcttgattccctgaaagtccatctgctgcatcggtcaagagaaactccacttgcatgaagattgcacgcctgcagcttgcatctttgttgcaaaactagctacagaagagaagcaaggcaaagtctttt

SEQ ID NO: 1175 - DNA, 255 bp, Homo sapiens
ggcgtaggtagatcgccgggggctgacgagtgcaccatggccaccgcggcaacctcacccgcgctgaagcggctggatctgcgcgaccctgcggctcttttcgagacgcatggagcggaggagatccgcgggctggagcgccaggttcgggccgagatcgagcacaagaaggaggagctgcggcagatggtgggcgaacggtaccgcgacctgatcgaggcggccgacaccatcggccagatgcgccgctgcgcc

SEQ ID NO: 1176 - DNA, 255 bp, Homo sapiens
cggggaagtgagagtcggggatcagtcctgcaagctacggagtcactacagggagaggtctcatcactagaaatagccgaagaacctgcagcctcaaccagcgttaaggaggacgtgccgtttctagggagtcttagtcggggctcaccagcttcctgcattttctgaccggctccaggaatagaaccaaaagaagctgaacaaggaagcagcgcggcaccaagaaaagcagaagtcggggccttggaggcgtga

SEQ ID NO: 1177 - DNA, 255 bp, Homo sapiens
ggcgcatgcgcgctgcggaagctggtgctggacagctggcgccggcagcagcggaccggcgggagacggcggcttgggagctggctgtgctgcaggagctgcggcagccgccgtccttgcacctaaggaacctctgctgccagcccttcctcacttttggaaatggcgggtgaaattacagagaccggggaactctactcttcctacgttgggctggtgtacatgtttaacctcatcgtgggcacgggcgcactc

SEQ ID NO: 1178 - DNA, 255 bp, Homo sapiens
ctgagaggagtgagtgccgtcaccgagggccgcgccagactgcgacggatacagggagggcaagggtttccttttggcgcttccctttggaccccggagtgaaaaactctaacgtccagatcagtggagagaaacgcagatttaggaccctgaggagtctttttcacccgtttcccgtcactcgctcaggcgcgccgagggcagtccttgtggggtcctcgtggccagccaagatggctgcccccgcagtgaagg

SEQ ID NO: 1179 - DNA, 255 bp, Homo sapiens
ctgaactttagctctctggccggcgcctctgttgcccggaagggaggcaagcccccttagagttgccagtaacggacatggctgcggcccccggaggaggggacgtgaagtgaggagggggttgggaggggagaggacgcgggcgaggaagaccagccccggggccccgatgttgtgactgtgacagactcactggggtttgtacatgctggggaggagccttcctttcaggggtgaccacattcatctgggcat

SEQ ID NO: 1180 - DNA, 255 bp, Homo sapiens
gtggcggcgcgcgcagcggcaggcggcggcgggatggagcccgagcccgagcccgcggccgtggaggttcccgcggggcgcgtgctcagcgcccgggagctcttcgccgcccgctcgcggtcgcagaagctgccccagcgctcgcatggccccaaggactttctgcccgacggctcggcagctcaggccgagcggctgcgccggtgccgggaagagctctggcagctgctggcagagcagcgcgtggagcgcctg

SEQ ID NO: 1181 - DNA, 255 bp, Homo sapiens
ggaggtgagcaggaaggagacggccgcccagcagcccgtgggcaggcgcggcggagcgagcggggccggcggcgggcgccgagggacgccgaggcctcgggcgggggctggcccggggttccaggtctccagtgggggctgcagactaagcaaaatgaggcggttcctgaggccagggcatgaccctgtgcgggagaggctcaagcgggacctgttccagtttaacaagacggtggagcatggcttcccgcacca

SEQ ID NO: 1182 - DNA, 255 bp, Homo sapiens
cccgccccttctttctccgtggccctttggcgcgtgagtgacagcggcccagacagagggggcgatgtccgcgtcgtggctggggccggtcgcggggcagactaatcccctgctcctggccaggggaggctcccgagcggatcctcgggaaaggggctccgaaggtcaagaaactgccctgctgggcgtccggggagtgggaaaataaagcactttttgtatcccgcccctcccccgtcacgtgaccacgcgagg

SEQ ID NO: 1183 - DNA, 255 bp, Homo sapiens
aaaaagcgcggagtcacggctggagggagggggagcggaattagcgggcagttggaaagcccgcgaaacgctttttccgcctgggaggccggacgatcgcgattgggcaggaggaagaggaggtgctccccatctgggcccccacctttttttcatgccaatactccaagttcacgccccttttttgctcagccgtcagccccgtctccgtctgaagagtgcttctgccctcatttgcctctccctgtgaccccg

SEQ ID NO: 1184 - DNA, 255 bp, Homo sapiens
acttgggttcagaggtcgtggcactgagatgggtctggcagatcccagcgtccaggcccagcccctatagtgtcagctccctcctctggggacccccttgcttgtgcccctctgggtcccagcacatcccaggcctgcagggagggggagaggaagagactgactcactggccaggtcccccaggggctggagaggctggagaggcaggagctggatcagatctgaatccagaggctctcggaggaagagctcag

SEQ ID NO: 1185 - DNA, 255 bp, Homo sapiens
gaaaagaaaaagaaggaaggtgctcagaaaaaggctgctgatcaaaaaaccaaagtgccagaacctactaagacctgttcaagccagccccaacctgccggtaccagtaccagtacttccaccagcactatctcaagcagcaacaatggcaaacgtgcatctgccagtggccagcagccagctgcatcccgttacctgcctcgtgaggtgcctccacgcttccgccagcaagaacagaagcagctattaaagaga

SEQ ID NO: 1186 - DNA, 255 bp, Homo sapiens
caccaccctgcctggcttggcaggagtcgtctgagaaggggactcctccagggacttggtccctaggtccccagatggggagactgaggccgtggctgtgtgtccctctgagagttggagcggggctgggcccgaattcgaccgcagcaggattctctctcatttctgagccccggaggtggcagagcggcagacccgggcaagtgaaccctagggctgcaggagcccaggccccgacgccggcgcagaggggac

SEQ ID NO: 1187 - DNA, 255 bp, Homo sapiens
acagtgtcatggaggccgcggcggtgacggtcacccggtcggctacacggcggcggcggcggcagctgcaggggctggcggccccggaggcggggacgcaggaggagcaggaggatcaggagccgcggccgcggcggcggcggccgggaaggagcatcaaagatgaagaagaagagacagtctttcgagaggtggtcagtttttccccggaccccctgccagttagatattatgacaaggacaccaccaaaccaa

SEQ ID NO: 1188 - DNA, 255 bp, Homo sapiens
cggtgcattctgggtcctggcaatatggcgtcctccttgatgggctgatgagatgagtttcactgtagctccaaaccagagggcaaagctcccatgacccaataagcccacattgtccctttcctccgtggttccgtgtcgcccgtttctcaggactcgttctcaggcaggagagagcctcggggctgaaggccaggaccagccaggccgcgcggacctgaggttgaggaaccgggtgcaggcgagcacgatggg

SEQ ID NO: 1189 - DNA, 255 bp, Homo sapiens
gctgccccggaagtggacggcacgccgcggcggggtgggtgcaagatgccgctgccggttcaggtgtttaacttgcaggtaacgagccgaggccgccccgggcctccgcgcccccgcgccccccgccactggggccgggctgaggtcgagcaggggcgcggggcctgcgccaggagtcggtcgggcacgctccgtgccgggcctccgcgggcagcgcgcgtcgggggctgcagggccgagggcgcgtctccgccg

SEQ ID NO: 1190 - DNA, 255 bp, Homo sapiens
ctctcgagtctccgccagatccggggcgggtccgcggccgcggcgggaacatggaggagctgctgaggcgcgagctgggctgcagctctgtcagggccacgggccactcggggggcgggtgcatcagccagggccggagctacgacacggatcaaggacgagtgttcgtgaaagtgaaccccaaggcggaggtgaaaagtgaccccaggtcactggcataggcagccagggtgccgcctgcacctgagaggtcgg

SEQ ID NO: 1191 - DNA, 255 bp, Homo sapiens
ggccagcgtcggttgccgccttagcgggcgcctccttttcatccctcatccttcatccctggctttcgcgctctagcggagtgggatctgcgaacacgtgaggcgggggcgcggtccccaggctgccgagatggccctgagcgacgaaccggccgcgggcggccccgaggaggaggcggaggacgagacactggcctttggcgcggcgctggaagcgttcggcgagagcgcggagacccgggcgctgctgggccg

SEQ ID NO: 1192 - DNA, 255 bp, Homo sapiens
aggcctaagcgcggccgccgtggctcctgcgtctcccatcgtgccgtgcgtcccgcgccgcgttcgagttctcggaggggagggggcgttagccccgcgcagccgccggcgtcgccgccatggacctaggacccttgaacatctgtgaagaaatgactattctgcatggaggcttcttgctggccgagcagctgttccaccctaaggcactggcagaattaacaaagtctgactgggaacgtgttggacggccca

SEQ ID NO: 1193 - DNA, 255 bp, Homo sapiens
agtgacgtcacggcccgtggcgcccttcgtggactgggctgtacggtgcgcgtgacggctgcgtgcggcgggaatcatggctgctcgcagagctctgcacttcgtattcaaagtgggaaaccgcttccagacggcgcgtttctatcgggacgtcctggggatgaaggttctgcggcatgaggaatttgaagaaggctgcaaagctgcctgtaatgggccttatgatgggaaatggagtaaaacaatggtgggatt

SEQ ID NO: 1194 - DNA, 255 bp, Homo sapiens
cagtgttttcttcttggggtcggaataaaagggctggaataaaagagggcagaaaaggcgccgggcgggcccgacacacgccggaggagccgggtggtgcagagccggagccggagccggagccgcgccgcgccgcaccatggcgcccaccctggccactgcccatcggcgccgctggtggatggcctgcacggccgtgctggagaacctcctcttctcggcagtcctcctgggctggggctcgctgctcatcat

SEQ ID NO: 1195 - DNA, 255 bp, Homo sapiens
gaactcgggttgcgcacttcccggcgctgggaacgcggagcggacgcagtctggccgccattgcgctgcggggaaagcggcctcttgtgtgagggcctgtgggattctccggatatggccggagtgtttccttatcgagggccgggtaacccggtgcctggccctctagccccgctaccggactacatgtcggaggagaagctgcaggagaaagctcgaaaatggcagcaattgcaggccaagcgctatgcagaa

SEQ ID NO: 1196 - DNA, 255 bp, Homo sapiens
cctggctgcgcgcggcggtggcggagccgctacggctgtagcagcagccgcgaagatggcggaagggctggagcgtgtgcggatctccgcgtcggagctgcgcgggatcctggctactctggccccgcaggccgggagcagagaaaacatgaaggaattaaaggaggccaggccgcgcaaagataacaggcgtccagatctggaaatctataagcctggcctttctcggctaaggaacaagcccaaaatcaagga

SEQ ID NO: 1197 - DNA, 255 bp, Homo sapiens
acgaggctagatggcttcacaagatggcggcgcgctgggagcgtatcatctgcgtttctaggagcttcgctatgcggctgctttaagattctagggttgtacaggcccacgccagacacgacgtctggcaggaacctcggcctcagagatggctctgagtaaatcaatgcatgcaagaaatagatacaaggacaaacctcctgactttgcatatctggcatccaaatatccagattttaagcagcatgttcagat

SEQ ID NO: 1198 - DNA, 255 bp, Homo sapiens
gattggcaggcgactccccgcccctgccccgcccccctgggcgaagagcgcggacttgtggggccgctggctgcagactggagctgcgcgggtcagggagataatggctgcgcggccgatcaccctcggcattgacctgggcaccacatctgtgaaggcagctctgctgagggccgcgcccgacgacccatccgggttcgcagtgctggcgagctgtgcccgtgctgcgcgggcagaggcggcggtcgagagcgc

SEQ ID NO: 1199 - DNA, 255 bp, Homo sapiens
tccgcgatcgctgctttcagctgggcaacagcacagggcggtcctgcgcatccggggggctgcgctcccagaccggtggctggggagtaggttgcaggggtgtcactgtgtcaggggaggaggaggaggaggaggaagaagaggtagcggcaaggtcgcggtctgaggttccggtgctcgccgccgcccagctcccagccgaggctttctcaaccgcgtcaataaaaggccgccccgacccgcccccgcgccccg

SEQ ID NO: 1200 - DNA, 255 bp, Homo sapiens; identical to SEQ ID NO: 1199

SEQ ID NO: 1201 - DNA, 255 bp, Homo sapiens
ctgacctggaagcggctggggccggagcacacgtgtttcgtgtttcggtgagtgtggcggagatggagagccgggatcccgcccagccgatgtcgcctggagaagcgacgcagagtggcgcccggcctgccgaccgctatggcctattgaagcacagtcgcgagttcttggacttcttctgggacattgcgaagcctgagcaggagacgcgacttgcggccacggagaagctgctggagtatctgcgtggcaggc

SEQ ID NO: 1202 - DNA, 255 bp, Homo sapiens
acaggcagcctcatccgccatcactccgggaaccgagcaccccgctgcctcggcgcccaggctgctctctccgcgcatgctccttcccagcttgagcccgcgagtccagcctgccttcactcagtgcgcaagaccgcagccccctccccacgccccctccccagtaggcggccgtcgcggtgtgtttgcgtcatcgcgccacgccaccactggaacccgggggaagatggcggcagccgttctgagtgggccctc

SEQ ID NO: 1203 - DNA, 255 bp, Homo sapiens
cccgcagggtccacacgggtcgggccgggcgcgctcccgtgcagccggctccggccccgaccgccccatgcactcccggccccggcgcaggcgcaggcgcgggcacacgcgccgccgcccgccggtccttcccttcggcggaggtgggggaaggaggagtcatcccgtttaaccctgggctccccgaactctccttaatttgctaaatttgcagcttgctaattcctcctgctttctccttccttccttcttctg

SEQ ID NO: 1204 - DNA, 255 bp, Homo sapiens
cgacgacaaggatggggcccatctcttcggagcctaaggatccagcccaggtccagccctgcgcagccgcccaccaagctgccagaagacgagccggacgcccaaggctacgagaggacgattgcagaattgtacaggctagtggttggggaatattttttcgtggaagggaccgtcttccttagctgtggccctctcatcaggtctgggaagaggtaattggaaaatagaactcatggagaagtgttaccacag

SEQ ID NO: 1205 - DNA, 255 bp, Homo sapiens
aaagccttcccaagcccccaaggcatgctgggagatgcagtccctttttctaaagactggggcggccgtgaggtcatcggtggtcgccgggagccgccagcacgtggcggcgaggaaggggcggtgtgctcctgttgtctgcacctgagagggggcaggagctctcggcgcttgcgcctcccgccgcggtgccctcccgacatgccggaggaggcgggcttcccgccggccaagagattccggccaggctctgga

SEQ ID NO: 1206 - DNA, 255 bp, Homo sapiens
atctccccaccctctcttctccaccagccaacgtccgggaaaaacgagtaagtacaggttccttctgccaatccccgccggccacagctaactttcccgcccggcccctttctgtcataattgaggtgtccacaaccagccaatcaggaacgcgagagtatcccgcgtttgctttcgctcgccgaggcgcgtatcagtcggaattttggggagccaaccgcgccgtctgtccctggcaagccagcggcggtttaa

SEQ ID NO: 1207 - DNA, 255 bp, Homo sapiens
cttgttgactaggcgctgttcttgctggctggtgccccagggcctggagaggtctgaagaaacctgggagccagcagcccggggctccactctgggttctgaaagcccattccctgctctgcggctcctcccaccccacctcttctcagccttgcagctcaagggttgatctcaggagtccaggacccaggagagggaagaatctgaggaacacagaacagtgagcgttgcccacaccccatctcccgtcaccac

SEQ ID NO: 1208 - DNA, 255 bp, Homo sapiens
tcccaggccaggaggtgccaggttagagcttggacactcagaccctccagtgcaggccttgcccggaccagcccctcctccactctcctctcccctgtgagctccacctgccccagttctcctggctttaacccctccttggccaaggccagggttgcctgcgggagccaggtgtccgctctccacacctttcacagatcctacccaggccaccaccccgaacccctccgaccctgcgttccatcccaccatcaa

SEQ ID NO: 1209 - DNA, 255 bp, Homo sapiens
agcggagatggcggcagggtcgggtgggagtgggggctctgggggaggccctggaccggggccgggcgggggtgggggccccagcgggagcggctcaggaccggggtccaacgggggtctgggcagcggcggggaactgcacccgcgcactgggcgcttggtgagcctgtcggcctgtgggcgtacggcgcggcggcagcagccgggccaggagtttaaccacgggctggtgttgagccgagaacccttgcgcga

SEQ ID NO: 1210 - DNA, 255 bp, Homo sapiens
agagtcgtgggtaaaccccccgctcgctggttgggcgaccttttgaagtgacagggagagaagaatttttttctttaatcccaccgcctctcctcgctgctcccttttgcactgaggcttaaggtttgaagactcgagggtaaaattgggccgctttcattctagtttggacaacggtttcatcttcagcaaaagcctctcattcgtagccccccccagctggaaaatggtctgctctgcgaatcgaaggaagag

SEQ ID NO: 1211 - DNA, 255 bp, Homo sapiens
ttctttttttttttcctccgggaagatgagatatactcattcttgaaaatacctccgggcttgccttctgcacacttctttccctccctgtctcacgccatggtagcgtccgcctaggttgcaggcgacccgcggggtggggcacaccattcaaagaaggggagggattgaggtttgcatcaaaacaaatacccctgcctttgcaaaggccataactaagtaatccagaaaaagaaatgcaggcggagaatagca

SEQ ID NO: 1212 - DNA, 255 bp, Homo sapiens
atctttccgtcccgggcagccagcgccagtcggagccagcgcgagccgccgccgccatcactgccgctgccaagtcctccacccgctgcccccgccatgtctgctaccgctgccacggccccccctgctgccccggctggggagggtggtccccctgcaccccctccaaacctcaccagtaacaggagactgcagcagacccaggcccaggtggatgaggtggtggacatcatgagggtgaacgtggacaaggtc

SEQ ID NO: 1213 - DNA, 255 bp, Homo sapiens
tgggcagatgctgcggctcgccgcgcggctccagctggggcgcggtggtcccgacggtcacccgaatcgcagggagtcgccgctggagaggggctcggcgcccggcggggactgcaggcgatgacccaggatgcagccaggggccacgacatgcacggaggaccgcatccagcatgccctggaacgctgcctgcatggactcagcctcagccgccgctccacctcctggtcagctgggctgtgtctgaactgctg

SEQ ID NO: 1214 - DNA, 255 bp, Homo sapiens
agctcggtgcacggcgcgctgattggctggatccgccatgcggagcggctaggtggtgcacgggaaacgcgggcgtaggtgaccggcggctttctcagttttggtggagacgggcgcatgtgggcgctttgctcgctgctgcggtccgcggccggacgcaccatgtcgcagggacgcaccatatcgcaggcacccgcccgccgcgagcggccgcgcaaggacccgctgcggcacctgcgcacgcgagagaagcgc

SEQ ID NO: 1215 - DNA, 255 bp, Homo sapiens
gcgggctggggggagggagaggggttgagtcaagatggcggccaaggtggcgaagcagcagccgcggcggcggcggcggctggagtgagcgtccgactcgccgcgccgaacgaggtcccggtgtagggccgcgcgccgtggccgcgtcccactcctcaggccggggcgcacgtcggctcccacgcttagccagctcccggtggtttcctagaaacatgattgtttattggcattgatctcacagtctggtgagga

SEQ ID NO: 1216 - DNA, 255 bp, Homo sapiens
gcagtgacgccgaggcgaggtcgcggctaagcagaggcgccggggtttctgggccgggcttctcaggaccgggctggaacgtgcagctcctggccgggacactctgtgctttgcggggaagggaagtggcggagcccgaggatccgctgccgctcgggactgagcccgccacgcaggcgcctgtgccagcgtcgccattgttgcctgtggccttagggccgctccggctgcccgtcggccgggtcccagcgacag

SEQ ID NO: 1217 - DNA, 255 bp, Homo sapiens
agagacgcggcaagggggcggggccaaaggccctaagctcggcgttccagagagtggggagggggcaagtgtcagtcaggacgggagtccggcgggttacagcggaggcctaggtggcagacagggggcccgggccgctgcgtgttgtccacccaagatggagttcctcctggggaacccgttcagcacaccagtggggcagtgcctcgaaaaggcaacagatggctccctgcaaagtgaggattggacgttgaa

SEQ ID NO: 1218 - DNA, 255 bp, Homo sapiens
cctgtttctcccccatcaggagcagtttcagtctcaacttcaaaagaacaaacgcgcactcaaaacaaaggaagaccgtcctcgactgcagaggaagcaggaagctgtcggcccagctctgagcccagctgctggagccccgagcagcggcatggagtccgtggccctgtacagctttcaggctacagagagcgacgagctggccttcaacaagggagacacactcaagatcctgaacatggaggatgaccagaa

SEQ ID NO: 1219 - DNA, 255 bp, Homo sapiens
ccggaggagtcacgtagctctgcgacatccgcagcctcatttaccagagggagccagggctgcagcctcatctgtttgcggatcagaacccgagctgtgcttgtggctgcggctgctaactggctgcgcacagggagctgtcaccatgcctcactcgtacccagccctttctgctgagcagaagaaggagttgtctgacattgccctgcggattgtagccccgggcaaaggcattctggctgcggatgagtctgt

SEQ ID NO: 1220 - DNA, 255 bp, Homo sapiens
gagtgggcgggccatttcttgttctctctcccgctctcggaagctttcgtctcgtgggtgcgaaaggtaaccgaagcggctcaggaaggcagctgtcactgagcccctggaacagagcgagagtatcgtaagtaaccaggctcagccggtttctcaggccgctctagtcaaataaaccataaagatcagactcgggcttcttcacttccttctctccgtggtttcgccattagcttccggttccggggaggggcc

SEQ ID NO: 1221 - DNA, 255 bp, Homo sapiens
aggaatttccggggatcgtgttacagcgttggcggagcccgagcggagtgggactcgaggccctgtagccggactgggcccctcgccccctcctccagcggcctgcgggccttggcagcgccgcccctgcccacactgaccccgtgtggcggggccgctccgcgcccccgggccgctctgtaatggtagggcagcctcagccccgagatgacgtcgggtctccgcggccccgggttattgtaggaaccatccggc

SEQ ID NO: 1222 - DNA, 255 bp, Homo sapiens
cgggtggctttgcgggcgctcgcggtaagtttgcgccaagtgcgcggcagccgggacgcagacggcggcggcggcgagaggcggagcccggggaccaccccccatcaccctccccccagtcacctcacgtaccacaacctcacgtaacctctcaccccccctccgatacccccagccccgggatggcagcgcccgccagccttcccggccggaccggctgtcgccagtgccggctttagcctgtgggactaggcc

SEQ ID NO: 1223 - DNA, 255 bp, Homo sapiens
agatatactgagtgagccctgagaagcagtctcagatcctgacggtgcagcagcccgcagcctcagccagggagtcccagccgctttcaatggaggagaagcccggccagccacagcctcagcaccatcacagccaccaccatccgcaccatcaccctcagcagcagcagcagcagccgcaccaccaccaccattattatttctacaaccacagccacaaccaccaccaccaccatcatcaccagcagcctcacc

SEQ ID NO: 1224 - DNA, 255 bp, Homo sapiens
ataaatttgagtcagcaccagcgacagctctgcagtcctcctatgtggtactgatcaggtggttgcagagcttcagctcacagcaacacaatgcagctgagcaggcaagcacagcccacagccagaaacagttccgactctacagaacaagacgacctttaagtttcccagagaaaatgagatgctgatgttgaagacgacaccacggctttgatggaatatcagatattgaaaatgtctctctgcctgttcatc

SEQ ID NO: 1225 - DNA, 255 bp, Homo sapiens
agaaactatttcagtttgctagaggaacattttaaatctgaattgaaccacccattttcctttcttagccaaatcaccaaaatgtccagttagaacaagaatttagcattctgcaaaagaagttaacagctgagataacgaggaaatattctgaaatggatcccaaatatttcatcttaattttgttttgtggacacctgaacaatacatttttttcaaagacagagacaattacaacagagaagcagtcacagc

SEQ ID NO: 1226 - DNA, 255 bp, Homo sapiens
ctggtctaacagacccgcgagaacgaaggacgcttgcctttttccggtcggggaagggggaagaaggtaacttccggtgacggggttgcatcacttcctctcaagcttggcgtttgtttggtggggttacacgcgggttcaacatgcgtatcgaaaagtgttatttctgttcggggcccatctatcctggacacggcatgatgttcgtccgcaacgattgcaaggtgttcagattttgcaaatctaaatgtcata

SEQ ID NO: 1227 - DNA, 8178 bp, Homo sapiens
tgtttgacccggaagtggctgtgttcagctgacagctgctgataaggtggcggcggcgaaggcagcggcaggtcgggagcaagatggcgctgcggccaggagctggttctggtggcggcggggccgcgggagctggcgcggggtccgccgggggaggcggcttcatgtttcctgttgcaggtgggataagaccccctcaagcaggcctgatgccgatgcagcaacaaggatttcctatggtctctgtcatgcagcctaatatgcaaggcattatgggaatgaattacagctctcagatgtcccaaggacctattgctatgcaggcaggaataccaatgggaccaatgccagcagcgggaatgccttacctaggacaagcacccttcctgggcatgcgtcctccaggcccacagtacactccagacatgcagaagcagtttgccgaagagcagcagaaacgatttgaacagcagcaaaaactcttagaagaagaaagaaaaagacgccagtttgaagagcagaagcaaaagctcagacttttgagcagtgtgaaacccaagacaggagagaagagtagagatgatgctttggaagccataaaaggaaatttagatgggttttccagagatgcaaaaatgcaccctactccagcatcgcaccccaagaaaccaggcccttccttggaggagaagttcctagtatcttgtgatataagtacatctgggcaggaacaaattaaattaaatacttctgaagttggccacaaagccctaggcccaggttccagtaagaagtatcccagtttaatggccagtaacggggttgctgtagatggatgtgtaagtggtaccaccactgcagaggcagaaaatacttcagatcaaaacctgtcaattgaagagagtggtgtgggagtatttccctcacaggatcctgctcagcccagaatgcctccttggatttacaatgagagtttggttccagatgcctataagaaaatcttagaaaccacaatgactccaactggaatagatactgccaaactgtatcccattctgatgtcatctgggcttcccagggaaactcttggacagatatgggccttagctaatcgaactacacctggcaaacttacaaaagaagaactttataccgttctagccatgatagcggtaacacagaggggcgttcctgcaatgagtcctgatgctttaaaccagttcccagcagctcctattccaactttaagtggcttttctatgactctgcctacaccggtgagtcagccaactgtgataccttcaggtcctgcgggctccatgcccctcagccttggacagccagtcatgggcattaaccttgttggaccagtgggtggagctgcagcccaggcttctagtggtttcataccaacctaccctgcaaatcaggtagtaaagccagaagaagatgacttccaggattttcaagatgcttctaagtcaggatcccttgatgactcattcagtgatttccaagagttgcctgcttcttcaaaaacaagtaactcccagcatggaaacagtgccccttctttgttgatgccacttcctggaactaaagcattgccttcaatggacaaatatgctgtgtttaaaggaattgcagctgacaagtcctctgaaaatactgttccacctggagatcctggtgataaatatagtgctttcagagaacttgaacagacagcagagaataaacctttaggagaaagctttgcagaattcagatctgcaggaactgatgatggtttcaccgattttaaaacagccgatagtgtatcaccactagagccaccaacaaaagacaaaacttttccaccatccttcccctcaggaactatacaacagaaacaacaaacacaagtgaaaaaccctctgaacttagcagacctagatatgttttcctcagttaattgcagcagcgagaaaccattgtctttttcagctgtgtttagcacatcaaaatcagtttctacaccacagtcaacaggttctgctgctactatgacagcattggcagcaacaaaaacttctagtttggctgatgattttggagaattcagcctttttggggaatattctggtctagcacctgttggggagcaggatgactttgcagattttatggctttcagtaatagctctatttcatctgagcaaaagccggatgacaaatatgatgcccttaaagaggaagccagtcctgttcctctaaccagcaacgtgggcagcacagtgaagggtggacaaaactcgactgctgcgtctaccaagtacgatgtcttcagacaactttctctggaagggtctggactaggtgttgaagacctgaaagataacactccttcaggaaaaagtgatgatgattttgctgacttccactccagtaaattttcttccataaactcggacaaatccctgggagagaaagcagtggctttcagacacaccaaagaagactctgcatcagtgaagtccttagatctcccttccattggtggcagcagtgttggcaaggaggactctgaagatgcactctctgttcagtttgacatgaaattggctgatgtgggaggagatcttaagcatgtcatgtctgatagctctttggatttaccaacagttagtggccagcatcctcctgctgcagatatagaggacttaaaatatgctgcttttggaagctacagtagcaattttgcagtgagcacacttacaagctatgactggtcagacagggatgatgcaactcagggcagaaaactctctccatttgtcctctcagcaggaagtggatccccctcagccacctcaattcttcaaaagaaagagacttcatttggcagttctgaaaacatcaccatgacatctctctccaaagtaacgacctttgtaagtgaagatgctcttccagagaccaccttcccagctcttgccagttttaaagacacgattcctcagaccagtgagcaaaaggaatatgaaaacagagactataaagatttcacaaaacaggacctgcctacggctgaacggagccaggaggccacgtgtcccagcccagcgtccagtggtgcctctcaagaaaccccgaacgaatgttcggatgactttggagagtttcaaagtgaaaagcccaaaatcagcaaatttgacttcttagtagccacttcacaaagcaaaatgaaatccagtgaagaaatgatcaaaagtgagctggcaacctttgacctttctgttcaaggatcacacaagaggagtttgagccttggtgataaagaaataagccgttcttctccttctccagctttggagcagcctttcagagaccgttccaatactctgaatgagaagcccgccctgcccgtcatccgagacaagtacaaagacctgacgggagaggtggaggaaaatgagagatatgcatatgaatggcagagatgcctggggagtgccctgaatgtcattaagaaggcaaatgataccttaaatggaatcagtagtagttctgtttgcacagaagtaattcagtcagctcaaggcatggaatatttattaggtgttgttgaagtgtacagggtaaccaagcgtgtggagctggggataaaagccactgcagtgtgcagtgagaaactccagcagttgctgaaggacatcgataaagtatggaataacctaatcggcttcatgtcactcgccacactcacaccagatgaaaactcgctggatttttcctcctgtatgttacggcctgggattaaaaatgctcaggagcttgcctgtggagtgtgcctcttgaatgtggactcgaggagccggaaagaagagaagcctgcagaagaacatcctaaaaaagcattcaactcagaaacagacagtttcaagctggcctatggagggcaccagtatcacgccagctgtgccaacttctggatcaactgtgtcgaaccaaagcctcctggcctcgtcctgcctgacctgctctgaacaactcctctgtgaagcattgacttttttttttctgtgacaccccacggggtgacagggaccaataaatagaatgcgagcactgcacagttcgcttccctgaatcgatatgaagaacaccgcaagggacggggcccccgtcatccccacggccagtctgcaggacttcaggtaaaattgtcccacccaaactgcacgtggcaccagaagcttgctcacttatctctacttaagattttctgaaatacggaccacggctttcttgatctaaggaagaacttgctgctgcagtattgaaactgtgaagaactgacatttgaagaaaaatagattaccgttgcgggactagaatgggcgactgcttggagccagtgcttgtttttatctaggacacttactgtcctgtgaagtagaatacatttatctgcatttagtttgttaatgtctgaaatgaataaaaagaggaaattgcgattaaactgatgttctgctttttatggagaagattctgcccatctcccctggacagtagcaggcaggtgagggcagattttacccacttggttgtcacaactgaaccagttctctactccttcccttcacttctgtccactctcaagactttttcccaaaacatgcctgggcactctgcagccgtgaagaatgctcattttgacagaggcccaaatcctgtgtattaggataatatccttccccccgggagccttcgctgcaaacctgttctgccgcatgcaaagactgtgaccatggagttttctcagacaagatttggaaaggcagtggaatgaaatctctttgcagtggcctctctccaaatttccaaagatgactgcatagggaccaacactgcctgactttgcagtatctgtgagaaaaacctgaaaattaattcagggtgaaaatgtggagctctcggcctagtgtaaagtatcaagatgtatatttatgggatagatacatgacttagaagaagtagaagaaaattgtccagaaacagtactgaattttagatagaaaaggctcatgcttcctggagtagggaattgtctttgccatttaatgtgaatgcataaaattaggggaaaaacccaagtggctaagagctgtgttattcctgggaagaactaccaatctagggcacacgtctctctgaattgttgattatgcgctttatgaagagatttttcaatctcgtgtgctttactttgtgtggtttagaccctctgacctagacttttatttttaaactgaaaaagttggtcttgtctatataattgctgcttttacataatttattttcccctctcaggacaaattctgtcttgctccatcttacagcttttccatgttctccaagaaaggtgtggaacattttcattaaacagctgttgctgaggcttctgcttgaccttctgcgtgcccgaatgcacagagaggcaccgaggagagaaaggcttttctcactcgctcccgatgataccgtctctggccattcctgactgaggcagctcactctgaatgggcacctttggagcttttgcccaccacaaggctagtggggtgtttctaacaacacaagtgggacagcttttggcaggcttttcctgaggcctcggcgcttccatcctggacagcaccacttccacatggagctggaatgcaagcaggctgctaattggccttaaaaattctttgtttttttttgagatggagtttcactcttgttgcccaggcttgagtgcaatggcacaatctcagctcagtgcaacctccgcctcccgggttcaagcgattctcctgcctcagcctcgtgagtagctgggattacaggcgtgcaccaccacgcccagctaattttgtatttttagtagaggcaaggtttctccatgttggccaggcttgaactccggacctcaggcgatccgcccgcctcagcctcccaaagtaccgggattacaggcgtgagccactgcgcctggcctaaatttcataacagaaccatgacagcagaatctacctttgcaataagaatgtttcccaggagttagagaccagccctgggcatgatggtaaagaccccagctaattatacaaaaaataattagccgggtaggtggagtgcatctgtggacattcgtggtcccagctactaggtaagctgaggcgggagatcacaagtccaggagtttgaggctgcacgtgacagcgtaggtgatgacagagcgagacactgtctcttaaaaaaaaaaaaaaaaaagtttcccagtttgaatttgtattgctgaagcatttttttgaaatgctatatagatgcctgtcatgtcacagtggcccagtatcaacattttaaaaagctcacttggtagctgggctggtttctattcctgagaaattccagaatgcctcagataaaattccttagtataatccccattttccttaccaaggatggtaggcttagtcactccttgggaggtgccacaggaaaattcagcagatgtcaacagaaaaaaagcctttgctatgaaaagtattcactacctttcatatctcttgaatacttgaaatgtttaattagatgccaccaatagggatccaaggagtgtgggacacggttgcgctgcttttctttataaacgtttattaaaatggctcaacgctgcattcagcttcacctcagctcttcttgtcagccaggagccccgtgtccttggaaactgtagccaaggttacttatttccatactgtgcattgtgtcagcccgcttcaccccactgcttgaatggccattaataagcacttttctttttttggtgggatgttttgcctttaaaatttttatggcttagtgtgtaatttaatttttgtctggacatgcttgagatagaagaggtactggatatatgaggatattttccatgctttatttttcctgtggctactagttagcattccataggggttgtgaatttttaattatttgaatattttgtgtacatatacatatttgaagggttttgggggggtcttatttgtttaaaggtgtcttctgtttgcctatttcaagtgtacttcagctttgcaaagattatagggctgtatgttacagaaataggaaatgctggccctgtactggggaccactacaaaaattccctttagccgggcgtggtggctcacgcctgtaatccccagcactttgggaggccgagccgggtggatcacccgaggtcaggagttcaagaccagcctggccaacatggcgagaccctgtctctactaaaaatacaaaaattagctgggcatggtggcaggtgcctgtaatccgagctactcgggaggctgaggcaggagaattgcttgaaccagagaggcggaggttgcagtgagccgagatcgcgccactgcactccagcctgggcaacaagagcgaaactctgtctcaaaaataaaaaattccctttaacaccttcaaggtcaaatgcctgcctttgtgaacagttaataaactgacattttcagacatttgccattcagaagggagcattgtagcctgctgtagaccattccagcaaatgtcagaatgcagggcaagatgtgtgtcgactatgttttttatgtttaagttacttacttatttcttcaggtaagtgtgtaccaaataacaatactgaaaagccctccccttgccaggccgaggaaataaagcttaagtgaaacagctcttgggggaaaaatgccactttacaaatacttttctaacaaaatagcattataatgaagtttttacttaattccattatttatatgttgacgtgaatgtaagtggttaaaaagtattcatgtgggacatctcattactttgtagctgtggctttattaaccagtgaatgctgtggcccttagcgaaatgcgttgtcttctgcgtgatgtggaattcgcgcctgtattttaaaagatggtgtggtttctcccttgtttgtattttaataaacaactgctctaattgatgtgtttagacattataaagcttcacctttaaaatattttcagggtctgttctgaaatcaccccttgttaaacttctctaaccaaaatacaagtgtagaagaatgtcaggctaaaaaaaa

SEQ ID NO: 1228 - DNA, 255 bp, Homo sapiens
agctccccgcctgctcccggaggccgcagcctccagctccgctcgcgctctcgccgctcctgccggctcgcccggccccgcgctccgccgtctcctcgccgcccgcccctccgccagccccggggaccgcgcggccgcagcctgagccagggccccctccctcgtcaggaccggggcagcaagcaggccgggggcaggtccgggcacccaccatgcgaggcgagctctggctcctggtgctggtgctcagggagg

SEQ ID NO: 1229 - DNA, 255 bp, Homo sapiens
gagatgctgagcctacgggggaggcggcggcggcagtggagagagcgggaggagcgagggaaggcaggaaggaggcagccgaaggccgagctgggtggctggaccgggtgctggctgcgccgcgctgctttcggctcccacggcctctcccatgcgctgagggagcccggctgggccgggccggcggcgggaggggaggctcctctccatggtccagaagaccagcatgtcccggggcccttacccaccctccca

SEQ ID NO: 1230 - DNA, 255 bp, Homo sapiens
atactcctaagctcctcccccggcggcgagccagggagaaaggatggccggcctggcggcgcggttggtcctgctagctggggcagcggcgctggcgagcggctcccagggcgaccgtgagccggtgtaccgcgactgcgtactgcagtgcgaagagcagaactgctctgggggcgctctgaatcacttccgctcccgccagccaatctacatgagtctagcaggctggacctgtcgggacgactgtaagtatga

SEQ ID NO: 1231 - DNA, 255 bp, Homo sapiens
ctccctcgagtccctgagtctctgtagtgcctcagctcctggatgtcctcccttaaaggagaagaacaatgcgggccgactagacgagtcccttagtttcctcgccggcgcagacaaatacggtttcagtccaaggaactaccattcccagaagacagcggggcgttccttgctgcatttctattggttggcgtttgttactcccagccaatagaaagtgagcttcttgacaagtgccaaaatggcgatgcctac

SEQ ID NO: 1232 - DNA, 255 bp, Homo sapiens
gggcacgaggcgctccctgggatcacatggtacctgctccagtgccgcgtgcggcccgggaaccctgggctgctggcgcctgcgcagagccctctgtcccagggaaaggctcgggcaaaaggcggctgagattggcagagtgaaatattactgccgagggaacgtagcagggcacacgtctcgcctctttgcgactcggtgccccgtttctccccatcacctacttacttcctggttgcaacctctcttcctctg

SEQ ID NO: 1233 - DNA, 255 bp, Homo sapiens
cacttcctccccagacaggggtagtgcgaggccgggcacagccttcctgtgtggttttaccgcccagagagcgtcatggacctggggaaaccaatgaaaagcgtgctggtggtggctctccttgtcattttccaggtatgcctgtgtcaagatgaggtcacggacgattacatcggagacaacaccacagtggactacactttgttcgagtctttgtgctccaagaaggacgtgcggaactttaaagcctggttc

SEQ ID NO: 1234 - DNA, 255 bp, Homo sapiens
ggcgggaggagagtcggcggccggagccgtcaccccgggcggggacccagcgcaggcaactccgcgcggcggcccggccgagggagggagcgagcgggcgggcgggcaagccagacagctgggccggagcagccgcgggcgcccgaggggccgagcgagattgtaaaccatggctgtgtggatacaagctcagcagctccaaggagaagcccttcatcagatgcaagcgttatatggccagcattttcccattga

SEQ ID NO: 1235 - DNA, 255 bp, Homo sapiens
tgtggtgcgaagccacctcccccgccgaatcgcgcatctgcgcagttgctgttattgtgacttgtcgggccacggccccggatgttgtggctgccgcggggagatggctgaggccgaaggggttcccacgaccccaggcccggcttcggggtcgactttcaggggccgccgagatgtgtcaggctcctgggagcgggaccagcaggttgaggcggcgcagcgggccctggtggaggtgctggggccttacgagcc

SEQ ID NO: 1236 - DNA, 255 bp, Homo sapiens
ctcgcccggcgccccgcccctcccgctggatcccgcagccgcggctcttcccgacgcgttccgccttccccagctgtgcactctccatccagctgtgcgctctcgtcgggagtcccagccatgtccgacgagagagaggtagccgaggcagcgaccggggaagacgcctcttcgccgcctccgaaaaccgaggcagcgagcgacccccagcatcccgcggcctccgaaggggccgccgccgccgccgcctcgccg

SEQ ID NO: 1237 - DNA, 255 bp, Homo sapiens
gcgagcccccgcccagctgatccgccgctctccgcctcgcttgctcctgccgggcgtgcagggccccgccgccgccatgtcgggctcgttcgagctctcggtgcaggatctcaacgacctgctctcggacggcagcggctgctacagcctcccgagccagccctgcaacgaggtcaccccgcggatctacgtgggcaacgcgtctgtggctcaggacatccccaagctgcagaaactaggcatcacccatgtgct

SEQ ID NO: 1238 - DNA, 255 bp, Homo sapiens
gtggcttcgcgactgcggaaggttgcccgggctggcgccgctgggcagagccggtgcgacgtttccctttccagctttgttcttccggccctgctgtctgcctccccggctgattggattcgttactgctttgcaacgcgcacctaactccagacggggtctcactctgtcgcccaggctggagtgcagtggcacaatctcagcttgctgtgacctcagctctctgcgacctctgcttgctggactcaagcgatc

SEQ ID NO: 1239 - DNA, 255 bp, Homo sapiens
agacacacaccagtggcgacaggggagagttggaaagacgcaggagagaagcaggaggcaggaggcagcggggatggagcaatgggagcgggaagcaggcaggtttccttgcaaatccccctccggcctcacgccgtctcgccggccccggcaggggagcgaggaccccggcgaacagatggaggagtggagctcgctctaggcagctgggcttggccggagaatggaggagccaccaagcgaccggctgattgg

SEQ ID NO: 1240 - DNA, 255 bp, Homo sapiens
gtcgcgcgcggagcaggggctagagggaagggtcagcctccagggctggcaggcgcctgcgccgcggggctcccgtcaggacgcgcattctcgctccctccctcggctgcgcgcgcccggtgggcgtgggaggaggcggggaaccggggaggggtgggtgtcgcaggagggaaggagcgaaccggagagcgtcgtcctgagaggagtgaaggcggcaaaatggcggaccgcttctcccgcttcaacgaagaccga

SEQ ID NO: 1241 - DNA, 255 bp, Homo sapiens
gggagctcagcggtcggcggccggcggcgggagatcgcgggcgagcggagcgcaacactcgcttggttggggagatcggcgcttggccggatgagcacaagcctgggagatggcagtgatggaaatggcctgcccaggtgcccctggctcagcagtggggcagcagaaggaactccccaaagccaaggagaagacgccgccactggggaagaaacagagctccgtctacaagcttgaggccgtggagaagagccc

SEQ ID NO: 1242 - DNA, 255 bp, Homo sapiens
gcagcagctgctgccactgctcagcgcggtgaggagggagccggtgactcggagacggtgactcagaggcagagcggcgcaagggccaaggagtactggcgtccatggaccctggggaccccgtcaggagcaggtgacatccttccccttccaccctgctccctgctctacatccccagcagggagtggcctctcccttctccatggacttccaagagagggacccgcccttcctgcctgagagcgctcagtcct

SEQ ID NO: 1243 - DNA, 255 bp, Homo sapiens
agctcctatgaggcccctgccgccggtcggcgatgtccggctggagctgtcgcctccgccgccgctgctgccggtgccggttgtgagcgggtctccagtcggctcctctgggcgtctcatggcctctagcagctccctggtgcccgaccggctgcgcctgccgctctgcttcctgggtgtctttgtctgctatttttactatgggatcctgcaggaaaagataacaagaggaaagtatggggaaggagccaagca

SEQ ID NO: 1244 - DNA, 255 bp, Homo sapiens
agaaggagcgaagctctggcccggcgtgtagcgggcgcactacggggacgctgggccgggcaccgggctgtgtggagaagtgagcgcgctcgtctgacccccgtgcccgccaccccgagccactaacggcgatctcccaaggcctgcccgaggcctctgtcctctgtcctcagccccgcagcggcaacgtcttgcactcggcgagctcgccgctcccgaccctcccgcgcccccgccctgccgcgctgctccccg

SEQ ID NO: 1245 - DNA, 255 bp, Homo sapiens
cagctcctcacgctcggtgcccgcgccccgcagcggcagcgcagaacgcaccgcctctgccagagcccgggaagcgctcgggcgaagaggaggagccaagggtaccgagcgggtggagtcgggagccggagagcggtggaggcggatttcctgggcccggccctctggcgctaccatggcgtttggcaagagtcaccgggatccctacgcgacctccgtgggccacctcatagaaaaggctacatttgctggagt

SEQ ID NO: 1246 - DNA, 255 bp, Homo sapiens
gtggccgcgctcggcgctgccatgttgaggagccgccgctgccgttgccgccgccgccgccgccgctttgttgtcgcctcctccggctgaggaggctccccgagcggggggagtggggaggaggggggtcggccgccgcagccatggaggccaactggaccgcgttcctgttccaggcccatgaagcttcccatcaccaacagcaggcagcacagaacagcttgctgcccctcctgagctctgccgtggagcccc

SEQ ID NO: 1247 - DNA, 255 bp, Homo sapiens
gttgcgctcccgcgcgtgcgtgttgggatcgaatcgctgtttccttccgcttctcttcctctgtctcccccccatatccgtgcgccgagctgataaaggcgccattttggaggggccgcgggagacgtggtgccgctgcgggctcgctctgccgtgcgctaggcttggtgggaaggcctgttctcgagtccgcgcttttcgtcaccgccatgtcgggaggtggtgtgattcgtggccccgcagggaacaacgatt

SEQ ID NO: 1248 - DNA, 255 bp, Homo sapiens
aatcagaggaggaggggactgcagaggaaccaagtgatcctgctgcagctgagctgtccttggagggtgggagccaagggaaggggaggagaagaggggtggggaaggacattccacaggcttttttggcccctgccagagacagaagggggtcaaagagaaagggaaaggagcaagccaggaagccagacaacaacagcatcaaaacaaggctgtttctgtgtgtgaggaactttgcctgggagataaaattag

SEQ ID NO: 1249 - DNA, 255 bp, Homo sapiens
gtttctctctctggtcggaggcggcggtaatggcggatggtgggttgtggcgccggcggcggctgctgtgagggacgatgagtgcctccttcgtgccgaacggggccagcctggaagattgtcactgtaacctcttctgcctggctgacttgacaggaattaagtggaaaaaatatgtatggcaaggcccaacttctgcccctattctgtttcctgtgacagaagaagaccccattttgagcagttttagtcgct

SEQ ID NO: 1250 - DNA, 255 bp, Homo sapiens
agcgataaggcggtggcggcggcggtggctcggggaccactggtagcggcagcagctcgcgcccgcgccctcctcgtacccgtgcgcccccggagaccgatcccgccccgcggcccaggccgggcctgaacccagcgggtgccgcttctccacccgaggcttccacctccaacgagccatgttccaggctgcaggagccgcccaggccaccccctctcatgacgccaaaggcggcggcagcagcacggtgcagcg

SEQ ID NO: 1251 - DNA, 255 bp, Homo sapiens
cggcgcggcggcggctgctagggcctgccgcagccgcggccactcggaaagggcgggacttccccgcagggcggggtggggcggagcgctctatcagtcctcccggtcgccccactgcgcatggcacgttgcgtactcccctcccagcaaccggtctggcggcggcgcggcagtaaaactgaggaggcggagccaagacggtcggggctgcttgctaactccaggaacaggtttaagtttttgaaactgaagtag

SEQ ID NO: 1252 - DNA, 255 bp, Homo sapiens
gacacagcagatccggtcgcaggcagcgtccagcatggactggtccaggcacctccgacccacccgacgctcctgccccggcccgctctccactcagatcacgctcgctccgcacccagccccgtaacctgccgggccgccactgcacccgccatacctgctctggtccgtcaagcgccatcttctctcttcagcagagaccgccggcatccgagccgtcttggcgcgcaagcgcggaagcggaggattgggacc

SEQ ID NO: 1253 - DNA, 255 bp, Homo sapiens
ctgcagccggtgcagttacacgttttcctccaaggagcctcggacgttgtcacgggtttggggtcggggacagagcggtgaccatggccaggctggcgttgtctcctgtgcccagccactggatggtggcgttgctgctgctgctctcagctgagccagtaccagcagccagatcggaggaccggtaccggaatcccaaaggtagtgcttgttcgcggatctggcagagcccacgtttcatagccaggaaacggg

SEQ ID NO: 1254 - DNA, 255 bp, Homo sapiens
aaccggcgccagccatggcctctggggcgggcggaagctggggtcgctccccaccgcagagcgcagtcccgacgccctgggtcaccttcctgcagcccctctcgtgggccgtcccacctgcgcccccgcagccaggccgcgtgaaggaagacctgctggaactgatgatgctgcagaacgcgcagatgcaccagctgctgctgagtcgcctggtggctggagcgctgcagccccggcctgcctcgccctgccctc

SEQ ID NO: 1255 - DNA, 255 bp, Homo sapiens
tgcctagtcagttctgcgtccgctgaggctcggtcaccgcctcgctgtcgtcgcggcgcccccgccccgtcctctgtccgtaccgcccccggagccagggccgagtcctcgccatgccggcccggcggctgctgctgctgctgacgctgctgctgcccggcctcgggatttttggaagtaccagcacagtgacgcttcctgaaaccttgttgtttgtgtcaacgctggatggaagtttgcatgctgtcagcaaga

SEQ ID NO: 1256 - DNA, 255 bp, Homo sapiens
gtgtgcccgggggcgggcgggcggcagggcagcaggaccgcggccggtgccccagccgaagccggagtcgcgcggccgggagcacgggcgccggcatagtacaatgaggcagccagcggatcttggagcctgagcccttgtgaagccggcaatgacaagtctgtatggtcgccatgccgagaaaaccactgacatgccaaaaccatcagcccctaaagtgcacgtgcagaggtccgtgtcccgagataccatcgc

SEQ ID NO: 1257 - DNA, 255 bp, Homo sapiens
tgggattataggcgtgagccactgcacctggcacaggctgaagtgcaatgttgtgatctcggctcactgcaacctctgcctcccaggttcaagcgattctcctgctttggcctcctgagtagctgggattgcaggtcagttgctctccctggaaggaagagtgttctcggatttcaccttaaaggaggaaggctgccagaactgaactagcacttctgaatatcctgaggcgaggtccggtgacttccttgggaa

SEQ ID NO: 1258 - DNA, 255 bp, Homo sapiens
ctccttccctccctccctcccccgctgtcctggcccgccctgcccggcccgccctgcgagtcagttcgctggttccctccctccctgggcgcgctcgggccgccgccgcgctccccgccctcgagcctcggtgccggagccgcccgccgccggaggaggaggtggagggagccggaggggcccgccgaggcggcggcggcggcggcaagatggcggacttcctgccgtcgcggtccgtgctgtccgtgtgcttcc

SEQ ID NO: 1259 - DNA, 255 bp, Homo sapiens
accggcgacccggcccgtggagccggcgcgggcgggctgctgaggtggctgtcgccggctccgagctgcggcttcccgggccgagcccccgatggaggccgaggccgcggacgctcccccgggcggggttgagtcggcgctcagctgcttctctttcaaccaggactgcacatccctagcaactggaactaaagccgggtataagctgttttctctgagttctgtggagcagctggatcaagtccacggaagcaa

SEQ ID NO: 1260 - DNA, 255 bp, Homo sapiens
aaaggcgcaagaagcgggcaccccgggaaccccattccctcggctcactcggcgcggagaagcgacgcccgctgactccgagagccccggtgctccgtgcacctggtccccaagttgaggagcgacacccctccacaggggactagcccgcgcggggagcattccggtctcactgaccccggcccacccgcgggactccaggcacctcttctgcccgcaccccgcgacccctcccgggaccccggagacagccgg

SEQ ID NO: 1261 - DNA, 255 bp, Homo sapiens
gggaacgtggctggttggaggaggtagatcaccctttctgcgggggacgatttcgtcggtggtaggctgctaccatgaggttgaatcagaacaccttgctgctggggaagaaggtggtccttgtaccctacacctcggagcatgtgcccagcaggtaccacgagtggatgaaatcagaggagctgcagcgtttgacagcctcggagccgctgaccctggagcaggagtatgccatgcagtgcagctggcaggaag

SEQ ID NO: 1262 - DNA, 255 bp, Homo sapiens
ctcgcgagttttgaagccgcggggccgggcggctgcaatatggcggaggcggaaggggaaagcctggagtcctggctcaccacaacagaaacactgccggggaggccgagccccgacctgggaagcagggtgatacactgggtgccacgggccttccctctgcctggcagctgtcgctactcagatccctgcagccctgttgccagtgaaggagctggagtctctgttatgatgtgttcatccagctgataaagc

SEQ ID NO: 1263 - DNA, 255 bp, Homo sapiens
gagcgcagagcggtttggtcgttcgttgggcggtgctggtttttcgctcgtcgactgcggctcttcctcgggcagcggaagcggcgcggcggtcggagaagtggcctaaaacttcggcgttgggtgaaagaaaatggcccgaaccaagcagactgctcgtaagtccaccggtgggaaagccccccgcaaacagctggccacgaaagccgccaggaaaagcgctccctctaccggcggggtgaagaagcctcatcg

SEQ ID NO: 1264 - DNA, 255 bp, Homo sapiens
gggaccaagagcggaagtgggtgtgacggggacgggggcccggtgggcccgcggaggaaagatactggggagtgggagccgcggggttcagagcgatgattcccccacaggaggcatccgctcgacggcgggagattgaggacaagctgaagcaggaggaggagactctgtccttcatccgagacagcctggagaagagcgaccagctcactaagaacatggtgtctatcttatcatcctttgagagccgcctta

SEQ ID NO: 1265 - DNA, 255 bp, Homo sapiens
agaaggtttcatttccgggtggcgcgggcgccattttgtgaggagcgatataaacgggcgcagaggccggctgcccgcccagttgttactcaggtgcgctagcctgcggagcccgtccgtgctgttctgcggcaaggcctttcccagtgtccccacgcggaaggcaactgcctgagaggcgcggcgtcgcaccgcccagagctgaggaagccggcgccagttcgcggggctccgggccgccactcagagctatga

SEQ ID NO: 1266 - DNA, 255 bp, Homo sapiens
aggtggggaaatggtcaaagagcgatgggcccagaaaagggtcagacccagatggagatgccactggctgctagcagacccccacgctgggtctagcccacccaatcccatggggatgctcctgtgctctgcagacatctgggtgctgccacaggggcccgacagagttggcatctgggtggatctgagccaagtggtgcttctgggcctcagcaagtagctggtgctgattctgggcagccaactgtggcagca

SEQ ID NO: 1267 - DNA, 255 bp, Homo sapiens
agcgcagcgcgaacgctgggtgcggcgcctttaagcgtcgcggtgacacgtgtgtgaggcgccggaggcccggatggtgcgcgtgctgggccgcgggccgaaggagtcgccagggctgcgtaggcttgtggcgcgcccgcggagaggccggggctctgacgcccgctctgcggcttcggtgtttgaacaggccacagtccaggagcgcttacattcaggagctccgcgtagcacctgcccaaccaaactcagccc

SEQ ID NO: 1268 - DNA, 255 bp, Homo sapiens
ctgagctctgagcgcctgcggtctcctgtgtgctgctctctgtggggtcctgtagacccagagaggctcagctgcactcgcccggctgggagagctgggtgtggggaacatggccgggcctccgaggctcctgctgctgcccctgcttctggcgctggctcgcggcctgcctggggccctggctgcccaagaggtgcagcagtctccccactgcacgactgtccccgtgggagcctccgtcaacatcacctgctc

SEQ ID NO: 1269 - DNA, 255 bp, Homo sapiens
ggccggcggccacgtgacccaccgcggcggggccggcggcccagaaatagcagcggcggcggttccgcccgcgggcggcgcgagcgaggggcagaggcgagagacgccggcggggcgcgggcgcggcggccccggaggatgctgctgagccccggcactgcctggctgcgagcacatgatggcgatacgggagctcaaagtgtgccttctcggggacactggggttgggaaatcaagcatcgtgtgtcgatttgt

SEQ ID NO: 1270 - DNA, 255 bp, Homo sapiens
agaagctcccggccgggggcgcgcacgtaggcacgcagaggccgtcacgtgggtcgccgaggctcgcaagtgcgcgtggccgtggcggctggtgtggggttgagtcagttgtgggacccggagctgctgacccagcgggtggcccaccgaaccggtgacacagcggcaggcgttagggctcgggagccgcgagcctggcctcgtcctagagctcggccgagccgtcgccgccgtcgtcccccgcccccagtcagc

SEQ ID NO: 1271 - DNA, 255 bp, Homo sapiens
aggcaggggcggtgcgggggcgtgggcagcacaagccgtgcgctcccgggctgcgaggtctggctaggctacgggccacgcgccgccgccgctgccgccgccactgtcctcttcggaggcgcgggcccgacggaaaccatgtttgtggctcgcagcatcgcggcggaccacaaggatctcatccacgatgtctctttcgacttccacgggcggcggatggcaacctgctccagcgatcagagcgttaaggtctgg

SEQ ID NO: 1272 - DNA, 255 bp, Homo sapiens
cgctcatggagccctggcattgagtgtgagcacttcacactctacctctctcagttggccctccgaaatgcctcaatttaggagtggtgccccactgtggagggtattttcaggaccatcttacaaattattgtgaagtgttggaaacaaagagcttcctgcttcttttcaacctggttctaccatgttccaagctgtagccaaaaggaaaataaatcagagcttgaaactagcctttctgatgggaatatctat

SEQ ID NO: 1273 - DNA, 255 bp, Homo sapiens
aacagaatcgcgtttggctgtgctggatgtgtgaacctattgggtactgtacaacttcaagcctcgaaatcagataggcaccaccaacctcatttcctgtttcaccttgattttctgtgataccaaaatctcagcttcacaaagtcattgaaagtgttggttcatgaagttttaccatcaattcaagtaatcataaatggcaaattctgcaaaagcagaagaatatgaaaagatgtctcttgaacaggcaaaagc

SEQ ID NO: 1274 - DNA, 255 bp, Homo sapiens
gtcacaacccgcggaaggcgccgtgcgccggttgctatacaggccgcacttcacaccccgtgcctccccgcctctcctggctcctccgcccagatccccggcgctcccgcgttcggtgacggccgggtaggctgtaggcagcgcaatgccaagacagagctgctggcggcggcgggcgaatctccctgcaccatgagcctcggctccggccccgttaggggccgataagcacagcgcacgccgccctccatttgc

SEQ ID NO: 1275 - DNA, 255 bp, Homo sapiens
gtgatttctgatgaaactggattggaataattttcatgatctttgtatatttatatatatatatttttaaattttgcatttgacttaaagtgccatgagaaaatttgcatactgcaaggtggtcctagccacctccttgatttgggtactcttggatatgttcctgctgctttacttcagtgaatgcaacaaatgtgatgaaaaaaaggagagaggacttcctgctggagatgttctagagccagtacaaaagcc

SEQ ID NO: 1276 - DNA, 255 bp, Homo sapiens
agttccgctccgagggcggaagtgcgcgtctcttgtttgtgcggctgaccagttggcgacatggtggcacccgtgctggagacttctcacgtgttttgctgcccaaaccgggtgcggggagtcctgaactggagctctgggcccagaggacttctggcctttggcacgtcctgctccgtggtgctctatgaccccctgaaaagggttgttgttaccaacttgaatggtcacaccgcccgagtcaattgcatacag

SEQ ID NO: 1277 - DNA, 255 bp, Homo sapiens
atgttgtttttcctgtacctaagttcccgctgtaggtggtacctttgcagacggtgcgatgggggaagcagagaagtttcactacatctatagttgtgacctggatatcaacgtccagcttaagataggaagcttggaagggaagagagaacaaaagagttataaagctgtcctggaagacccaatgttgaagttctcaggactatatcaagagacatgctctgatctttatgttacttgtcaagtttttgcaga

SEQ ID NO: 1278 - DNA, 255 bp, Homo sapiens
aactcaccattttgtaagctgcctccatcatcctaaaaaacgaccatgctgaaagagctcctctgtatttcttggcagaccctttccagttttcatcctgggtgtttctgaacaggaacatatctcattgaagtatttgcacctctacctacagacaaggaaaaggcttggagcacctccattcattgtgccaacaggacctgaatgaccgattgtttcttgcttactacttgtggtcaactaagtagagattca

SEQ ID NO: 1279 - DNA, 255 bp, Homo sapiens
accgtgggccacgccttccgggccccgcggctggccggctcctcgcgccctcccctctctcggccgctcttcgggccgcctctgcgtgtggggccgcccgcgccagtgtgagcctgagctgacggcggctccgggaggctcgcagaaggggagggccgggcggcgcgggagctgagcatcgccagggcgggcggcagggcgcggcctctccgccgggtgtaccacctgtcgcggcgcgagacctctggtgaaaga

SEQ ID NO: 1280 - DNA, 255 bp, Homo sapiens
gtaacaactctcagaggagcattgcccgtcagacagcaactcagagaataaccagagaacaaccagcatttcttgcactacaacttgcttaagctcttacacttcatagtgaagctatgcaccaccgagtgaagcgatgtggaacattggaaagagtgggcttccttagacagacctgggcttgaatccctgctccactacctaccagctgtgtgaccttatacaagttacttaatgtttctgagcatcaggata

SEQ ID NO: 1281 - DNA, 255 bp, Homo sapiens
acaggttatgagtgccagtgagccgccttagatagaagcatcgtcagcactttattaatgatggatagtgagaataaacccgaaaatgatgaggatgaaaagataaacaaagaagcacaagacttgacaaagctttcatcccataatgaagacggtgggcctgtatctgatgtgatagcaagtttccctgagaattctatgggcaaaagaggtttttcagaatcatcgaactctgatagtgttgttataggagaa

SEQ ID NO: 1282 - DNA, 255 bp, Homo sapiens
gcctggaaactacaaaggattgtgttaattttgtgtttaggaagaaagaggtaatgggtaggaatcaatgtaaacttattcataggccacaccaaaccaggaattcttgtcgtgattgcacttggtagagttaacacacgtgcacattacggaaacgttggtgaccaacaggcgtttcagcgagctttcgcacacctcatgggcctttgtgggctgctggagagatgttggctgcaccatgacccagatggagtt

SEQ ID NO: 1283 - DNA, 255 bp, Homo sapiens
ggcgggcgctcggcgactcgtccccggggccccgcgcgggcccgggcagcaggggcgtgatgtcacggcagggagggggcgcgggagccgccgggccggcggggaggcgggggaggtgttttccagctttaaaaaggcaggaggcagagcgcggccctgcgtcagagcgagactcagaggctccgaactcgccggcggagtcgccgcgccagatcccagcagcagggcgcgggcaccggggcgcgggcagggctc

SEQ ID NO: 1284 - DNA, 255 bp, Homo sapiens
cgccctcccgccgcgcgctcgggatcccgaccagtcctgaccgcacgggggccgcggccacggggcgcaggggccatggtgcgcggcaggatctcccggctctcggtccgggacgtgcgcttccccacgtcgcttgggggccacggcgcggacgccatgcacacggaccctgactactcggctgcctatgtcgtcatagaaactgatgcagaagatggaatcaaggggtgtggaattaccttcactctgggaaaa

SEQ ID NO: 1285 - DNA, 255 bp, Homo sapiens
ggcattatgcaattatattactaaggctgctacctgcccatgcccctctcctcctcctggtttggaactaccctccccatctgctgctatatttatctgccttcttggccataaaaggctggttgtgtggcctgacattcgactgcctgaccacatgcattatttttgaactggcccccagggtcctgtctttagccctgcctcttaacattgtcttggattcaacctaggtggagtcttcattctctcatccag

SEQ ID NO: 1286 - DNA, 255 bp, Homo sapiens
gccgacgtcagcgcgccggggcggggctggcggcaggagacgccgcgttgagagcttgggctcctccgtgagccgccggcgcgcttcgctgcctggcggcctttccccgagccgagcccgcttcccgaggccgccagtcgtcgcctgcccgcgcctgcgcagcgtcccgggccgagagggccacggcggcggccatggcgcaccgctgtttgcggctgtggggccggggcggctgctggccccgcggcctacagc

SEQ ID NO: 1287 - DNA, 255 bp, Homo sapiens
gtcggaagccgcgctccgccaggcaggagacactgtggtcgggagtaggcagcggcgccgcgtccgctctcgcccgctctcgcccgctcgccagccggctctcctcccgccgcaggacccgcgcgccgcgctcgggggccatgcagcgcctggccatggacctgcggatgttgtcccgggagctctccctctacctggaacaccaagtccgggtggggttcttcggctcgggggtgggcttatcccttatcctgg

SEQ ID NO: 1288 - DNA, 255 bp, Homo sapiens
caggggcgggctgcggggaggggcggcgccacctcgcgctccgccgtggtcccggcgccgggtcccggagacagacgttacgcgggctcgagcgtcctcggggagtgccagccagagttggtgacgaccacttcctcgacgtggggcgggcggacgggaagcctggggtcgtggccaccgcctcgggagctctgggagcccgggtgaccgcgtagaaatgaacacagaagcggagcaacagcttctccatcacgc

SEQ ID NO: 1289 - DNA, 255 bp, Homo sapiens
ggggagcgccatccgctccacttccacctccacatcctccaccggccaaggtccccgccgctgcatccctcgcggcttccgctgcgctccgggccggagccgagccgcctgcgctgccacagcagccgcctccacacactcgcagacgctcacacgctctccctccctgttcccccgccccctccccagctccttgatctctgggtctgttttattactcctggtgcgagtcccgcggactccgcggcccgctat

SEQ ID NO: 1290 - DNA, 255 bp, Homo sapiens
acttgtaggaaagcctctttgcatttagacgtaattgaactggaaggaaggagactggccagggaatagggggaaagaaattctcccgttgctcctcctactgtttatcacttgcctccggactgtcttccaaaccaagctcagctgcatcaaggtggcagcagaataccctgtgcaagtgccagcgtcttcttagccgctctgtgcatcccaggctgccctgttatctggccaccgtccctggccattgggact

SEQ ID NO: 1291 - DNA, 255 bp, Homo sapiens
agttgagtctgcggagccgcgggcagtggcagtcaggcctccccgctctgtgctacctgcggcccggctctcctccgcgcccccactcgcgctgcgatgacgcgctcactgttcaagggaaacttttggagtgcagacatcctcagcaccatcggctatgacaacattatccaacatctgaacaatggccgcaagaactgcaaagagtttgaagactttctaaaagaaagggcagcaattgaagagaggtatggc

SEQ ID NO: 1292 - DNA, 255 bp, Homo sapiens
ggctcggctgcggatcgtccctccctccggaagtgcggacattgtcagctgcgtttccgcggtcgcggttgaggagctcaagcttgggaaaatggtgtgcattccttgtatcgtcattccagttctgctctggatctacaaaaaattcctggagccatatatataccctctggtttcccccttcgttagtcgtatatggcctaagaaagcaatacaagaatccaatgatacaaacaaaggcaaagtaaactttaa

SEQ ID NO: 1293 - DNA, 255 bp, Homo sapiens
gggggcgtggccccgagaaggcggagacaagatggccgcccatagcgcttggaggacctaagaggcggtggccggggccacgccccgggcaggagggccgctctgtgcgcgcccgctctatgatgcttgcgcgcgtcccccgcgcgccgcgctgcgggcggggcgggtctccgggattccaagggctcggttacggaagaagcgcagcgccggctggggagggggctggatgcgcgcgcacccggggggaggccg

SEQ ID NO: 1294 - DNA, 255 bp, Homo sapiens
gagaattatcgcgatagcagcagcggccgggcaggtattgggggcgttccggaattgaggggtggttgtagtggtggcttaggaataccctcccggctatcgcttcagtgggtagaggggaccactgcccgagagctttaatggagctgggtcctgccttcgcgctgaggagccctcgttttcgagatcaggcctgaccgggataagctccagaaacagtattatgtctcagtcctgtgcaaagtgagatgagct

SEQ ID NO: 1295 - DNA, 255 bp, Homo sapiens
gcccccgtagttagcgcggtgcttctcttccgctccgggtcggctccgtttccctttccgggcgggcaggcggcggaccccagtgtctttatccctcttttgcacagtcagcttctgcagctctcccgggctagcatggcagcgtggaagagttggacggccctgcggctctgcgccacagttgttgtacttgatatggtcgtctgtaaaggatttgtagaagatttagatgaatcgtttaaagaaaatcgaaat

SEQ ID NO: 1296 - DNA, 255 bp, Homo sapiens
ggactgacgccgagacgcgcgcgggtcagcggcgcggggacgcggggcgctgggcgcggggctgggggcgcaggccccgaggccgcaggagcgcgcggagcggcgatgagcaggcggccggtggcccgcggggcgcggagcccgtgacagcctcggccaggcgggcgctgcgatggaggccgagggcctggactggctcctggtgccactgcaccagctggtgtcctggggcgcggccgcggccatggtcttcgg

SEQ ID NO: 1297 - DNA, 255 bp, Homo sapiens
ggccggggccagcacccacactgggtctccacagcggcatggaggcctgcgtgtcttcactgctggtgctggccctgggggccctgtcagtagctcctttgggacccagatcatcgggggccgggaggtgatcccccactcgcgcccgtacatggcctcactgcagagaaatggctcccacctgtgcgggggtgtcctggtgcacccaaagtgggtgctgacggctgcccactgcctggcccagcggatggccca

SEQ ID NO: 1298 - DNA, 255 bp, Homo sapiens
acgcggacgcggctggcggctcggtttctgcaaatgcgtgaatgagccggatgccagcctctgtcccctggagcccagcgtgaggaagaggcatgccccatcagccttcagcttgagcccggcggcccccgcccccgccccctgccaccctgcactgccccggctcccccgcggcccccacgctgcagtgcggccgggccccctccccgcaggggccgcccccgccgcccacccctagcgcccgtggtggtggtg

SEQ ID NO: 1299 - DNA, 255 bp, Homo sapiens
aggatgtgtagggggcggggcccggcggaagcgtatataaggccgggctcggggacgcccccccctcactcgcgcgttaggaggctcgggtcgttgtggtgcgctgtcttcccgcttgcgtcagggacctgcccgactcagtggaagcggggagaggtggtgagagatgacccctgttgaggatttcattggtgtctgccacaggccgccatggcatcagatgaaggcaaactttttgttggagggctgagtttt

SEQ ID NO: 1300 - DNA, 255 bp, Homo sapiens
cgcggcggcgcggggacgcgcggtgaccgttggcgccgaggggaggaggcagccgccgccgccgccgccgccgccgccgccgccgccgccgccgttgcgcagatccgggccgcggctgtggggagggcgacggagcgggtgaccttccggaggcgggagcgagcgaggaggcccgggagcgccgagcgtcgccgccgccgccgccatgaacaactcgggcgccgacgagatcgggaagctcttcgtgggcggtct

SEQ ID NO: 1301 - DNA, 255 bp, Homo sapiens
tgcgcggcgcatgcgtggcccggggtctcggggcgttgctgggaaacatctgccgttggttgcggcgggcaccggccgacatggcggcagcggtggcggctgcgctggcgcggcttttggcggcctttctgctcctcgcggcccaggtggcctgtgagtacggcatggtgcacgtggtctcccaggccgggggccccgaaggcaaagactactgcatcctctacaacccgcagtgggcccatcttccgcacgacc

SEQ ID NO: 1302 - DNA, 255 bp, Homo sapiens
tttggaaaaatgactcagtaagttcagcgcgcccgctccggccggccctgcgcctcccgccgcgcccgggatgtattcgtccccgctctgcctcacccaggatgagttccacccgttcatcgaggccctgctgcctcacgtccgcgccttcgcctacacctggttcaacctgcaggcgcggaagcgcaagtacttcaagaagcacgagaagcggatgtcgaaggacgaggagcgtgcggtcaaggacgagctgct

SEQ ID NO: 1303 - DNA, 255 bp, Homo sapiens
ctctcagggcgacagttacaggcaaagaagaggaagtggtagcactagctgtcgctccacaggcgagcagggcaggcgtgcgggcgggtgggtggtggaggctgcgagggtgcacggccggccctgggcaggcggtagccatggagctgtggcgccaatgcacccactggctcatccagtgccgggtgctgccgcccagccaccgcgtgacctgggatggggctcaggtgtgtgaactggcccaggccctccggg

SEQ ID NO: 1304 - DNA, 255 bp, Homo sapiens
ctcgcgcggcttcccgcttccggctcccagctgctagctactgtggatctgggggggccggacggaggcatcggaggcggctgcgagagtggcagaggagctggcggagagcggcctgcgggcgatcgggccgagcctcgctcaaggagcacccccggggcaccctcctgtccgatggcagcccggccctgtccaggaatgtcggtatgacggtctctcagaaagggggtccccagccaacaccgagcccggctg

SEQ ID NO: 1305 - DNA, 255 bp, Homo sapiens
ccccaccttgggacacacccggaagcggcggcggcgcccctcggggaagatggcgccctcggggctgaaggcggtggtgggggaaaaaattctgagcggagttattcggagtgtcaagaaggatggggagtggaaggtgcttatcatggatcacccaagcatgcgcatcttgtcttcctgctgcaaaatgtcagatatcctggctgagggcatcaccattgttgaagacatcaacaaacggcgggaacccattcc

SEQ ID NO: 1306 - DNA, 255 bp, Homo sapiens
tggacaaatttgcgggctggggaccatggaagtggaggaaatctacaagcaccaggaagtcaagatgcaagcaccagccttcagggacaagaaacagggggtctcagccaagaatcaaggtgcccatgacccagactatgagaatatcaccttggccttcaaaaatcaggaccatgcaaagggtggtcattcacgacccacgagccaagtcccagcccagtgcaggccgccctcagactccacccaggtcccctg

SEQ ID NO: 1307 - DNA, 255 bp, Homo sapiens
gagaattggaaggcggcagtgaagcggaagccattactctctggagtcgattgccccgagacacatgggccaaggaggggtcagcggcgaattctttcggcctgttggggacccctcgtgtccccacgccagactggacctcccgtatgaacttctcttcgcatcggcggcggcttccgtcacctccgctcccccgatcctattcccagtcgtatgccagcttggagagtcacgtgagagcaagagagtagcttt

SEQ ID NO: 1308 - DNA, 255 bp, Homo sapiens
aaagggggcggggcttcagccggtcacgtgttcccgcacctccccggcgcgcgcctgcccgcccgcccgctcgcccccggtccggactcctcctcctcctcttctcgccattgcagttggacccagcagcccggcgcgcaccgcgtggcttttgggggcagaccccggcgggctgtggcaggagggcggcggcggcggctgcggtcgaagaaggggacgccgacaagagttgaagtattgataacaccaaggaac

SEQ ID NO: 1309 - DNA, 255 bp, Homo sapiens
atgtccactccagacccacccctgggcggaactcctcggccaggtccttccccgggccctggcccttcccctggagccatgctgggccctagcccgggtccctcgccgggctccgcccacagcatgatggggcccagcccagggccgccctcagcaggacaccccatccccacccaggggcctggagggtaccctcaggacaacatgcaccagatgcacaagcccatggagtccatgcatgagaagggcatgtcg

SEQ ID NO: 1310 - DNA, 255 bp, Homo sapiens
gctgcgccgccattaagagctagccctcagaactatcctctctaaggtttcacagtcctgcccaagatggccgtctcggctctggcaccgcccccactcctgcctctcccaacatggcgaccctgagtctccgttcccggtgcggaacgtacgaccggaagtgacggggtccagaaatttccgctttctttctgcagcaggaaccgcggctgctggacaagaggggtgcggtggatactgacctttgctccggcc

SEQ ID NO: 1311 - DNA, 255 bp, Homo sapiens
ggtccgagttcggaatttcggttcaaggcccagttcctcggattgttcctgcgcaacttcagtttcccttccaggcacgggcaatgagtgtttggccgcgacgagttggaaagcccggatgcgtccttcggttgggcggggtgtctcagtgacgtcactgggggtataaaagggcctgggtggcgggcgcctgggcagagcgtcctagcagtgtcactgcgtgggttggtttgtgtagagaggcgtgagcgagcc

SEQ ID NO: 1312 - DNA, 255 bp, Homo sapiens
gtcgggaggagggcagacacgccgctttttggatgcctcctatgcctggcgggagtcttgtctgagctggcaccaccacacggcccacgacatcttcgcagggaagcctgtggaccctctgccaggctccacaagaggtcaggacagtgcagtgtgttcacaaggccagtttctgatcgtccgccccgaggctgaggaccagtaggcagctcccaagatgggtgaaaggaaaggggtcaacaagtactatcctcc

SEQ ID NO: 1313 - DNA, 255 bp, Homo sapiens
gtgaaaatggcgcccagctcgaaatcggagcggaacagcggggctgggagcggcggcggcggccccgggggagccggagggaagcgggcagcagggcggcggcgggagcacgtcctcaagcagctggagcgggtcaagatcagcggacagctctcccctcgcctcttccggaagctgcctccccgggtgtgcgtgtccctcaagaacattgtggatgaggacttcctctatgcaggacatatcttcctgggcttt

SEQ ID NO: 1314 - DNA, 255 bp, Homo sapiens
gcggaggcggcctgccggggtggttcggcttcccgttgccgcctcgggcgctgtacccagagctcgaagaggagcagcgcggccgcgcggacccggcaaggctgggccggactcggggctcccgagggacgccatgcggggaggcaggggcgcccctttctggctgtggccgctgcccaagctggcgctgctgcctctgttgtgggtgcttttccagcggacgcgtccccagggcagcgccgggccactgcagtg

SEQ ID NO: 1315 - DNA, 255 bp, Homo sapiens
gcccgcccgcgccccgaccagcccggcctcgggcagccactcaccggtgtccccgtccgcgtccttcctccccgggtcccggccatggcgctgagtgaacccatcctgccgtccttctccactttcgccagcccgtgccgcgagcgcggcctgcaggagcgctggccgcgcgccgaacccgagtccggcggcaccgacgacgacctcaacagcgtgctggacttcatcctgtccatggggctggatggcctgggc

SEQ ID NO: 1316 - DNA, 255 bp, Homo sapiens
ggggcgcagctccgacttcggacatggcgcacgctggcggtggcagcggtggcagcggtgccggcggccccgcgggccgggggctgagcggcgcccgctggggtcgctcgggctccgcaggccacgagaagctgccggtgcacgtagaagacgccctcacctatctggaccaggtgaagatccgctttggcagcgaccctgccacctacaacggcttcctggagatcatgaaggagttcaaaagccagagcatcg

SEQ ID NO: 1317 - DNA, 255 bp, Homo sapiens
ggtggcgccatcagtgtgggctgtgccgtggctggaagttactgtgaggcggcggctaagaaggcggctctggtggcggcggtggaggctgaggcggcggccgaggcggcgacggaggaaacagaagatggcagattttttgaaaggactgcctgtctacaacaaaagcaattttagtcgatttcacgcggactccgtgtgcaaagcctcgaaccgacggccctcagtctacctgcctacccgcgagtacccgtc

SEQ ID NO: 1318 - DNA, 255 bp, Homo sapiens
actttactagtcaagccgcggagtgggcggggccccctgcccagacttgaagccacacaggcaggtcgggcaggcgggtcgcaggttgtaaatccatgtggcgggggctttggaccctggcggcccaagcggcacgtgggcctcgcagattgtgcacgcgccggagcagcggcgcaccagcccccggctccggcgccaccatcttcgcgctaagctctggccaaggccgctgcggcatcgcagtgatccggacca

SEQ ID NO: 1319 - DNA, 255 bp, Homo sapiens
gctgagcaggagatgggaattgaaacctgcgcagaggcggctgtgcagggtgagagtggagccgaaaccacagaaagtgaagtttgcttcaacgtcttgtcccggcaggccactcagatgtgagagtgaggaagtgggatggggcctgaccggaaggaggtgcccctgagccgaggaacgcaggcggtggtcgtggggaagggaagaggagccccgggagacgacagcagcatgggtgggcggccttcgagccct

SEQ ID NO: 1320 - DNA, 255 bp, Homo sapiens
acacaagcctccaacttggtgctgacggaagtggcctcgtggctgtctcctggcgcctgccccgtcagacaggggccccatcccactcgctaccctgtccgatggggaaactgaggcacggagctggacagtgactcagacaccaggagctgcctggagtggagctgagagctcaggtctgggctcagccagtccagagtgcaaatctactgtcccttcctagctgtgtgatcttgacaggcactggacggggcc

SEQ ID NO: 1321 - DNA, 255 bp, Homo sapiens
gggattttctgctccggttggtgagcgcgcctgcgcgttgacggcgattttgcgttctgaggctgcagcgtcggcatcttgagctgccggttcgcgagttcgaggccaggttccgcctgtcgtgggttcgcaccccggacgcgatgctattcgacaaggtgaaagcgttctcggtgcagttggacggcgcgaccgcgggcgtcgagcccgtgtttagcggcggccaggccgtggcgggccgggtgctgctggagc

SEQ ID NO: 1322 - DNA, 255 bp, Homo sapiens
tggttaaaggcgcttatttcccaggcagccgctgcagtcgccacacctttgcccctgctgcgatgaccctgtcgccacttctgctgttcctgccaccgctgctgctgctgctggacgtccccacggcggcggtgcaggcgtcccctctgcaagcgttagacttctttgggaatgggccaccagttaactacaagacaggcaatctatacctgcgggggcccctgaagaagtccaatgcaccgcttgtcaatgtga

SEQ ID NO: 1323 - DNA, 255 bp, Homo sapiens
tttcttccttctggctggccggccgcagggtagggggtccgtggacctcccggcctgtagggggcgtcgggcgcagcggaagggcctgctccggagcctggccagggctgcgcagtcatgatcaccgagaccgcggcggagcctacggtccctgcagtgcctgctgctgaggaggccaccgaagctcggggacgcgaggagccggcgtggccctggaaagacgccccgatccggacgctggtgcagcgcatccac

SEQ ID NO: 1324 - DNA, 255 bp, Homo sapiens
ccagccggcgcttgcgcggtggcacgggcgagtgggggggcgaggaggtggaggaggaggaggaggaggaggaggtggcggcgagaagatggcgacttcgaacaatccgcggaaattcagcgagaagatcgcgctgcacaatcagaagcaggcggaggagacggcggccttcgaggaggtcatgaaggacctgagcctgacgcgggccgcgcggctccagctccagaaatcccagtacctgcaactgggccccag

SEQ ID NO: 1325 - DNA, 255 bp, Homo sapiens
ccggacgccgcacggctcctgttccggtgtcagagggcccgccctccccgctcctcagtctttgcggacaagaaaggggctgtgtgagacgcagggaaggaggcacacccgggggtggcgcagtgaggagggggcgcgacggccaggaggctggtggagcgacacccaggcaggagagggggaagaactctctccctttctgaacccccttttccttgagagacgagttgggggagtcctccacgcattacccac

SEQ ID NO: 1326 - DNA, 255 bp, Homo sapiens
ttagttcctcggggagcccctggtgccccggatacggctgattttgtcgtgtgggacctgttctggctgctccagccccaggaaggacccaggacacccggaagccggaaatggactcagtggcctttgaggatgtggctgtgaacttcacccaggaggagtgggctttgctgagtccttcccagaagaatctctacagagatgtgacgctggaaaccttcaggaacctggcctcggtcggaatccaatggaaag

SEQ ID NO: 1327 - DNA, 255 bp, Homo sapiens
caatcaggcacgcagcttgagcggagaggacggcttccgggatgtggcgggatttgtccgcttctttgtctttggctgccgctggaactccgggtctcgtcttcactgctctgtgtcctctgctcctagaggcccagcctctggtcctgtgacctgcaggtattgggaatccacagctaagacgccgggacaccctggaagcctagaaatggacgacctgaggtatggagtgtatcctgtcaagggggcaagtgg

SEQ ID NO: 1328 - DNA, 255 bp, Homo sapiens
ggcttgtgggatgtggcggggccgttgtttctggttccagctggagctccggatctcgtttttactgctctgtgtccttagcctctgtggccctgtgacctgtaggtatttggagatccacagctaggacgccaggaccccctggaagcttagaaatgggatcgttgacattttgggatgtgaccatagaattcgctctggaggagtggcaatgcctggacatggctcagcagaatttatataggaatgttatgt

SEQ ID NO: 1329 - DNA, 255 bp, Homo sapiens
agtgggtcttctcactcttttccaggctccttggaggtcactgccctgatgacaacatggtcttcccttcaaggaagccacgtttctaagagggctctggcatatgcattggtggtcactaactgccaagagagaatccagcattggaagaaggtagataatgactataatgcccttcgagaaagactcagcaccttgcctgataaattgtcttataatataatggtaccatttggcccttttgccttcatgcca

SEQ ID NO: 1330 - DNA, 255 bp, Homo sapiens
gacgtaacttccggtgtacacagccggtccaaggcggtgcgctgggggccggggcgcgtcgcaggaaaggacttagaagccttacaaatacatctgtgcattcttgcttcagactttacaactgagggccagcccagtctggaagcatctcttattaatgttacaaggaaaccgctacctcagcaaacaaaaggaatggaggaggagacttacaacaaacgccatttaaaaaaaaaagaaaaacttgttttcagg

SEQ ID NO: 1331 - DNA, 255 bp, Homo sapiens
gtgagcgccgggctcggggcccccccggccgcccgccccctcccctccctccctcccctcccctcccctcccccccgggccccgcgccccccccgcccccgccccccccatggacatgctggacccgggtctggatcccgctgcctcggccaccgctgctgccgccgccagccacgacaagggacccgaggcggaggagggcgtcgagctgcaggaaggcggggacggcccaggagcggaggagcagacagcggt

SEQ ID NO: 1332 - DNA, 255 bp, Homo sapiens
cagaaggtcgcgcgcgggcccccgccagtcaggtgggtgccaggccctggccgtggcgaaagagccggcggagccggagacccgctcccggagacgccgcctcgcgatccccgcgcgggcgggaccgggcggccggcatcatgaccctgtttcacttcgggaactgcttcgctcttgcctacttcccctacttcatcacctacaagtgcagcggcctgtgagtgcgggaagggcgcggggcggagagggcgcggg

SEQ ID NO: 1333 - DNA, 255 bp, Homo sapiens
atgcgtgcagtgttgcctcgcccaaagaagactacaatctccagggaaacctggggcgtctcgcgcaaacgtccataactgaaagtagctaaggcaccccagccggaggaagtgagctctcctggggcgtggttgttcgtgatccttgcatctgttacttagggtcaaggcttgggtcttgccccgcagacccttgggacgacccggccccagcgcagctatgaacctggagcgagtgtccaatgaggagaaatt

SEQ ID NO: 1334 - DNA, 255 bp, Homo sapiens
aagcgacggagatgcgcgcggggcctgttgggtgaaggagcagagcggccggaagcgcggagggagccgcgggatggaccgcagcctgccagttttctccattcaagatagtccctttggagatgcgcccctgggtcgaagccactactggccatcccagagccagacctggtgtcccaagaccctgagcccatccaggtctcagagatccaggctcccacaagctcccaaggctctagccacaggtcccaactc

SEQ ID NO: 1335 - DNA, 255 bp, Homo sapiens
gccgcctcgggctcggctctctccgcgcagaggtttcatggcttgcttcaatcttttgatatcttagagtaattgcttccaatttttgggcatcgccgcctcagtttacagaatagtatggatctggtgccagagccgggaaaacgatgcgcatcgtaaaccgcaaaacactgagcatccaggacagaagccaaggcgcttggcttggttgaaggccagtgcgcatgcgcgagtttacccttcgcggactgggcg

SEQ ID NO: 1336 - DNA, 255 bp, Homo sapiens
gcgcaggcgcagacgactcaccctgggccgggggtgaggcttggactgtttctttttccaaaagaggagctcaaaagagaaagttcatctagaaatctcaaagccatgtctcaggatgaactagagtatgcccttacagggatcagtgtcattcaaggatgtgactgtggacttcacccaggaggagtggcagcaactagaccctgctcagaaggcgctttacagggatgtgatgttggaaaactattgccactt

SEQ ID NO: 1337 - DNA, 255 bp, Homo sapiens
ggtgttgtcctcggaaacgtcgctggcgcggagggatggttcggcgctttaggcgtctgtcacagacctatctgcgggtcgccttcacccagcatctcagaaactgcgcgcgggatgaacattcgggtgtttccggcaggtgacgctgccgagtccccgcagcagggggcgagcaagggactcgcggttgacgggacacggatcctctaaggcccagagtgtcccgagtagcggcagtggggagtgctcagggta

SEQ ID NO: 1338 - DNA, 255 bp, Homo sapiens
cttggctccgcacctgctgggctggcgaacccgaaattgggcttggaacccgggagccagatcttggaccctgaactgcacctctgtcaagagcccagaggagaaagaatggctgtttcagtagcaatgtccaagctctgcattctccagactctgtgctttcctaagataggaacccagaagaggactgatcatttcttgcagctctaaaaaccatggctcggaaattagtgatgttcagggatgttgccattg

SEQ ID NO: 1339 - DNA, 255 bp, Homo sapiens
attgctctaaaaggcctctgtgccctgactgatcctccctccctgtcaactcctaatctttttattgtctccatagttttgccttttccagaatgttgtaatcatacagtatgtagtctttttgaattggcttctttcacttagcaatgtgcatttaagtttcctaagctgttgatcatgagactgagtccctttttatacttcaacagacatgagaacggcctcaaggaagactaaccatctgcaatactagaa

SEQ ID NO: 1340 - DNA, 255 bp, Homo sapiens
gcctgggcgcagcggtgcacccggacccggaacattctcaggcgaaagtgtctcttgcgtgcgtgggccggaggttagtgtgcggggcccgccgggcggttgaaaagtccgagagaatcaggatggaggccgtggcgacggcgacggcggcgaaggaacccgataagggctgcatagagcctggacctgggcactggggtgagctgagccggacaccagtcccatctaaaccccaggacaaagtggaagcagctg

SEQ ID NO: 1341 - DNA, 255 bp, Homo sapiens
aggggcgttgctgagggtagctgggggcgagagcgaggctacggagcaggcgagaggcgacggcgagagctagagcgggcgcagcgttagggtggccgtgcaaggggagccgtggcccgggcccggggcgtgcgagacggcggaagcagcccagggccttgctgccgccatgactgaggaatcagaggagacagtcctgtacattgagcaccgctatgtctgctctgagtgcaaccagctgtatggatcactgga

SEQ ID NO: 1342 - DNA, 255 bp, Homo sapiens
ctgctgaaaaagcagaaagagattaccagccacagacgggtcatgagcgcggtattactgctggccctcctggggttcatcctcccactgccaggagtgcaggcgctgctctgccagtttgggacagttcagcatgtgtggaaggtgtccgacctgccccggcaatggacccctaagaacaccagctgcgacagcggcttggggtgccaggacacgttgatgctcattgagagcggaccccaagtgagcctggtg

SEQ ID NO: 1343 - DNA, 255 bp, Homo sapiens
agacgctctgtggagacgcgagcacttccggtgtgtgagcctgcggttgctacataaccgcgtagtttgagccatttctgcgtctggcgggtccttctgaacttgtcaccttcgcttggggtcgcaacgacccgatgatcgatgatccaagcaagggaaaagaagccttggcggagagcggaggcacaattccaccttcctttgtgctccattactcaagacactgaagactccaaaaagtaggaggaaaaatga

SEQ ID NO: 1344 - DNA, 255 bp, Homo sapiens
tgtgggtgcggggagtggaattttggaacgaaatgtaacgaagagaagtacagtagtaagagtaacactgtagccgccaccggcaaggggtgcgcgctggggagcggacgctgcatcccctttctgctgcaggaacctctcatcagaccgcctgagggaagcggcgcccggagacccgccccggcccggtccacattctccccaggaagccggactctatggggcgggaccctgggggagcctgagccgagcccg

SEQ ID NO: 1345 - DNA, 255 bp, Homo sapiens
actaccgcgaggaacagcgcccaaagtcacgcgaagatgcagtttctccgtatccgcaggcttctttcgctggcgccattacctgagttctcctccagcgtttccgcaccctctccgattagcggtcccaggagtttccaaggtaaccgcgcagtagggcggatctcattaggcggaaagcgaaacccggaagtgacgctcttaccgggtgtcagcagcgagagggttcgaagatggcggcgcgcaagggtcggc

SEQ ID NO: 1346 - DNA, 255 bp, Homo sapiens
aaatttcctttcactttcggtctctggctgtcacccggcttggccccttccacacccaactggggcaagcctgacccggcgacaggaggcatgaggggcccccggccgaaatgacagtgctggcgccagcctggagcccaacaacctatctcctcctgctgctgctgctgagctcgggactcagtgggacccaggactgctccttccaacacagccccatctcctccgacttcgctgtcaaaatccgtgagctgt

SEQ ID NO: 1347 - DNA, 255 bp, Homo sapiens
agagcgaccatttagcttctgttgttaagtggatctaagcctatgtcgcttactggacgctgaagtgattgggaatattagcagtgggggttctgtagggtcaggaaggggcggctggctttgggggagtgatgaggggcttgttgggggtgggggtgcgtgataaagggatttctcggctgaagacgaggctgtgaggcttctgcagaacccccaggtcaggccacatcattgaggctgcaggatctctcttca

SEQ ID NO: 1348 - DNA, 255 bp, Homo sapiens
caaccacacacctggggaattgctggcctgacttctgacccctgactcctcatacccttcctccagagcatgacatttgaccaccaactgaaacctgacctctgaccccagaccactggcccttcccccgccctgtggtgacttcataaaggttactagcttctcccctggccttgagacccacacgatggccctgctggctctggccagtgccgtcccgtctgccctgctggccctggctgtcttcagggtgcc

SEQ ID NO: 1349 - DNA, 255 bp, Homo sapiens
aatcttggtcgctaggacacggctaacttccgctttcttccccctctcctaggctcaaactagtcaaatcttgttcactcgaccaatggcaaatcggaagtgggcgggacttcacaagtccggaccaaagaaacgcgagcttagccctgggtagcgcggccaatggccgtggagcagcccctgtaaactggctcgggcgcccccacgcccgcccttccttcttctcccagcattgccccccccacgtttcagcac

SEQ ID NO: 1350 - DNA, 255 bp, Homo sapiens
agattaacgcaaacccggaagcggatcgggtggagtgtaggtcatatcgccgcgatatctcttccaaatgcttgatgaaaaaggtgggaggatcacttgagccagggagttgaaggctgcagtgagccctgtttttgccaccacactccagcttgggattgattcctaaagactcatgttacgtgaggaagcagctcagaagaggaaaggaaaggagccaggcatggctcttcctcagggacgcttgactttccg

SEQ ID NO: 1351 - DNA, 255 bp, Homo sapiens
ccactgtactctatcgtgggcgacgacagagcaagagcaagactccgtctccgagaacaacaacaacagcaacaagaaaacaacaataaaaaaaataaggctgcgtgggaggcagaaagagctaatgcggccacgcttgtcccctcggggccaccgtccccacccagacttccggtctgccttaaaatgttcatgcgtaagtgcgtgggcaggaaggcgggctcaagcgcagctcgtggcgttcattggctgtgc

SEQ ID NO: 1352 - DNA, 255 bp, Homo sapiens
tccacccaagagcaacctggaactaagttattcggcaacgaactgttccactttgttgtgaggcaatagatgtggaaattccctgacgaggggctctgtcctcatacttcctgcggagcttattgtcgtaagaatatctgtcatcctgctaatgtgcattgaaaggagagcaacggggctgaggccgtgtcagcacgatggaccccaaacagaccaccctcctgtgtcttgtgctctgtctgggccagaggattc

SEQ ID NO: 1353 - DNA, 255 bp, Homo sapiens
ctctttccgtctcaggtcgccgctgcgaagggagccgccgccatgtctgcgcatctgcaatggatggtcgtgcggaactgctccagtttcctgatcaagaggaataagcagacctacagcactgagcccaataacttgaaggcccgcaattccttccgctacaacggactgattcaccgcaagactgtgggcgtggagccggcagccgacggcaaaggtgtcgtggtggtcattaagcggagatccggccagcgg

SEQ ID NO: 1354 - DNA, 255 bp, Homo sapiens
ggagagcgcgccacagaacgacttttacgcaggcgcagaagcctgtttcccctcacccgcggcttccaccctgcgcaggcgcaaaaagccgcgctggcaacctccgcagcggtcgcgcgcacccttcacccctcttgctgcttttgtctggcacaaccttctcaggccctccgcgaggccggccctttttttctttcactttccccacccggagagccaggtgccgagaactaggacctcgtccccttctctatc

SEQ ID NO: 1355 - DNA, 255 bp, Homo sapiens
agaatccaccggggtgcagcgaggctgtggaaagtcccacccagaacgtgaggtgaagaaggcttgggctgcgctggttctgctctgtccgggtcggagatgaactgacccgggagagcagcggagggatgtttcttttggccaacagtggggactcacctgcacgttttgcgaagaggcccacagtcctttgcgtggcgctcggactacatttcccaacggcccctgcacgccctgggggctgttccatgcggt

SEQ ID NO: 1356 - DNA, 255 bp, Homo sapiens
cgggcgggtgtggccaggggtgtgggtctgtgagggaccggtcggaagggcgtcgcgcggcctcgggtgacatgcggggggcggcgagcgcgagtgtccgcgagccgacgccgctcccgggtagaggcgccccccgcacaaagccccgggcgggccgaggcccgactgtagggactccagccaccttggccctccctgcccggggaaggccgcgctcaaggaatggcctcgcatccaaaggccagcgaggagcgg

SEQ ID NO: 1357 - DNA, 255 bp, Homo sapiens
gaaacagtgtggggcctagagcgctgggtgggcgcgttctgcggcctgagcagggacgggtagtgaagcggttacgccccttcttcgcgtcttggcgggagcctgacgccccgcttctcccctaacgaggtgtcccaccggcgcccgccgaggcctaggcctccgcagccgccctccgtctcctcagccccgacgctgcgccttgggccttgtgcgcatttttttcgggggaaaactgaggctcggagtgcgaaa

SEQ ID NO: 1358 - DNA, 255 bp, Homo sapiens
agaatcttccggcgtctttccggtggtggtcgtttttgctgcctgcgagcgcgtccgcgggctgggcgtttccggctcgctgggtccgggccaggtaactggagccggaaaccggtggaggtggtgtccgcccgcagaggagcttgcctggtctcggtctgagcgtcgcccagcgatttgccaccgcacgcacgccggatcccgggctttaccgcccgcctttccaggccccgccccgcctaaagtcccatggcc

SEQ ID NO: 1359 - DNA, 255 bp, Homo sapiens
cagggcgggacttgtggcgtcttcgcagcggtcattttggctgccctcccggaggtccgttctgtctgtcagccgctttggtacgctgcatcgggatcgaagtgacggaccgtgaaggcgcgagagtcaggtctgagggtcgggggcagagccgcccgcgaggccggcctggggatagcgatgctcgggttccccccgggtcgcccgcagctcccggtccagctccgcccacagactcggatggcgaccgcactg

SEQ ID NO: 1360 - DNA, 255 bp, Homo sapiens
tttccacgtgtgcacgtaacgtaaggccgagacttccggggtctctagtagcggctgtgtatcggcgatgcgggtgtttccccagtttgtggcccctgagtgctgggtgggaccgcggtgactgaacctagaaggtggagaggaatcgtcctcggtgcccagaggcggctctgcagccccgtgacggcgaccactgctcccgggccgtgcttccccaagtagtccgatggcagcggctgtgccgaggcgcccaac

SEQ ID NO: 1361 - DNA, 255 bp, Homo sapiens
acccgcccttcctcttcccaagggacgtcataattaatcccgcccccaccgccacccaaccaagcatcacccattccagcacttccggcctgacccctgtccagcgcctttcctttctccagcttctgctctgccccaagagtggtcgccttcgtggcagggcacgactctctcccagctcgggtcgccgcccacattagtgtggggccctgcggcctagcgtccctcaccagaggcctccccttgcctagctgg

SEQ ID NO: 1362 - DNA, 255 bp, Homo sapiens
ggggaggggacaggcgctgcaaggagcagagccgcgggaagcaactccctaagccacaatgctagtcgcgaacacaggaaaaagctcatcccgccgccgcggggccccatgctcccgccggcaatgactatgcctgtgggagcaacggctaccggcgcgcggccttctgggagttgtttgttgcgcggagcgcgggcacgtccgccggccaccggaagcaccgccattggccggtgcgtgcaggtggcagccaag

SEQ ID NO: 1363 - DNA, 255 bp, Homo sapiens
gttgtagtcgccgcgtcgccggtgcggccgccattgtccggcgttcggcgagtcgggtggtccctttggctggagtgcctctctggtctggggatcacctcaggcgctgtccttcactgggcgatccagcatggaccccgaggacgaaggggtagcgggagtgatgtctgtggggccgccggcggcccggcttcaggaaccagtgaccttccgggatgtggctgtggactttacccaggaggaatgggggcagct

SEQ ID NO: 1364 - DNA, 255 bp, Homo sapiens
ggcgcgcgggcgagcggttgtgcttgtgcttgtggcgcgtggtgcgggtttcggcggcggctgaggaagaagcgcgggcggcgccttcgggaggcgagcaggcagcagttggccgtgccgtagcagcgtcccgcgcgcggcgggcagcggcccaggaggcgcgtggcggcgctcggcctcgcggcggcggcggcggcagcggcccagcagttggcggcgagcgcgtctgcgcctgcgcggcgggccccgcgcccc

SEQ ID NO: 1365 - DNA, 255 bp, Homo sapiens
atggagtttgtgcgggcgctgtggctgggcctggcgctggcgctggggccggggtccgcggggggccaccctcagccgtgcggcgtcctggcgcgcctcgggggctccgtgcgcctgggcgccctcctgccccgcgcgcctctcgcccgcgcccgcgcccgcgccgccctggcccgggccgccctggcgccgcggctgccgcacaacctgagcttggagctggtggtcgccgcgccccccgcccgcgaccccgcc

SEQ ID NO: 1366 - DNA, 255 bp, Homo sapiens
gggaggccagggacctcactgggctgggcaggtgcaggccaccgccgtcccagtgccctcagaggcacctagactcatgtggacccggccgcagaccgttctgggcagctctgtccaggccggccctgccctctgacctggggccgcaggggctggccactgtgggctcggttccctgccaccccaattcatctgcaccccaaggaaagaaaatgaggggttgcagcgccccaggacccaagagcccccgaacac

SEQ ID NO: 1367 - DNA, 255 bp, Homo sapiens
gagtgtcggccccgcccccgcagaggggagcgagcgctcgcgggccggggcggagggttcggctgcgcggcggggctgaggcggccgcggggcccgagcgcagggagtggagcttggtttcgggatctcggtgctgcagacggcgagacctcctgcacagggtgtacagcaagctgtgattcctgggaaaactaaaaaagctctctgaacaacggggcccagagctgatggcagacaatgtcagccactaacaac

SEQ ID NO: 1368 - DNA, 255 bp, Homo sapiens
tggagcagcggggcctggcacacagtaggcgttctataaatgtgtcacaagaatggcttccctcaggaaggcggcattaccgctgcctttctgcagaaaaggaaactaaggctcagcaagaaccaccgcccagccagagccaaggtcacagagcacgtccgtggcacgcgtccaggtcgtgccacagcagggccggcggcttcgacgcgggcagccgggtcccttttctttgacagatggggaaaccgaggcccg

SEQ ID NO: 1369 - DNA, 255 bp, Homo sapiens
ctcttccgccgtcgtcgccgccatcctcggcgcgactcgcttctttcggttctacctgggagaatccaccgccatccgccaccatggtgaacttcacggtagaccagatccgcgccatcatggacaagaaggccaacatccgcaacatgtctgtcatcgcccacgtggaccatggcaagtccacgctgacagactccctggtgtgcaaggcgggcatcatcgcctcggcccgggccggggagacacgcttcactg

SEQ ID NO: 1370 - DNA, 255 bp, Homo sapiens
gacagctggtgtctgaagccgctcgcgcccagggtgaccctgtttgcagcacgatgtctgaagaagaggcggctcagatccccagatccagtgtgtgggagcaggaccagcagaacgtggtgcagcgtgtggtggctctgcccctggtcagggccacgtgcaccgcggtctgcgatgtttacagtgcagccaaggacaggcacccgctgctgggctccgcctgccgcctggctgagaactgcgtgtgcggcctga

SEQ ID NO: 1371 - DNA, 255 bp, Homo sapiens
tggcgcgggcaatccctcaacctgattggtcccctcgcccgtcactccagtgcgcccccaacctaccacgcagtaaaagccacccccgcctcggcccggacggtttccaagctggttttgaagtcgcggcagctgttcctgggacgtccggttgaccgcgcgtctgctgcagagaccatgtctgccgacggggcagaggctgatggcagcacccaggtgacagtggaagaaccggtacagcagcccagtgtggtg

SEQ ID NO: 1372 - DNA, 255 bp, Homo sapiens
cctcgcgccgcccgcccggcagcccggccggcgcgcgcacgccgcgagccgctggcgctcgggctccgctcggatcccatgcaacagccacgatgtgaagcggggcagagccgggggagcccagcccagccagcctccagacgttgccccatctgacgctcggctcgaggcctctctgtgagggaccggggggccatccccctccagggcggagatcggaggtcgctgccaagcatggcgcccacctggggccct

SEQ ID NO: 1373 - DNA, 255 bp, Homo sapiens
gttgtgccggggaacccgcggttggtggacgcgcgagcgtccttgctgctaagtacgctagtgggggcggtgcgcgtgcgcgtgcgcggccgcaaagcggggcgggaggaaacgagtgcgttttcctcttaggcggcgccattttgtgttcagagccgctatagctgccggcggtgtgcgactgagtcggtggcgaagacgggaacgcgacgatggcggagactctgcccgggtcgggcgactcgggccctggca

SEQ ID NO: 1374 - DNA, 255 bp, Homo sapiens
agatggctcgtgcgcaggtgcgtgctaggagcgcggctcgtcagggcaggctgctctgcagggcaggcgatccggggctcgcctccgcgcggcattcagcgcgcaggcgcgagctggccgcctcacacggagtcggcttgttaagtgcgcacgcgcgggagtttctggcagaaagcaggcgagcctgggccggcgcggggccttgtgggagggcttaaggaagtaaaatggcggacctggcgaacgaagaaaagc

SEQ ID NO: 1375 - DNA, 255 bp, Homo sapiens
actgcgcactgaggtggccacagtcgctaagaaggttgccatcgcgacgcggctgctcgagggtttcgcttccgggttaggcggccgcagaagcgtagaccgagtagcttgagcgcctcttccggttaccttttcccagcgccagaggcgcctagggttggggtcctcgctcaggcacagagacccgacaccgagcggcggcttccccgggatcgagggacgcgcacgccagaggagacgaaaggaacccgggtc

SEQ ID NO: 1376 - DNA, 255 bp, Homo sapiens
tctcctgtacctgggcatccagaaaaatggtggtgatggcgcgactctcgcggcccgagcggccggaccttgtcttcgaggaagaggacctcccctatgaggaggaaatcatgcggaaccaattctctgtcaaatgctggcttcgctacatcgagttcaaacagggcgccccgaagcccaggctcaatcagctatacgagcgggcactcaagctgctgccctgcagctacaaactctggtaccgatacctgaagg

SEQ ID NO: 1377 - DNA, 255 bp, Homo sapiens
ggtcgtgcgcgctgaggaggagccgctgccgccgtcgccgtcgccgccaccgccgccaccgctaccgaggccgagcggagccgttagcgccgcgccgccgccgcctcccgcccgccccggagcagccccgggcccgcccgcccgcatccagatttttgaaaaatacaatgtctaatggttatgaagaccacatggccgaagactgcaggggtgacatcgggagaacgaatttgatcgtcaactacctccctcaga

SEQ ID NO: 1378 - DNA, 255 bp, Homo sapiens
cgccgccgcgctcgctcgctccctcccttcctgcgcgcgcggggcggcgagacagcggcggcgacggcgcggaggccccgggcgcggcgcaggctccaaagaagaagaaaccaaggcccagagagggaggcccaggtgcagggagcaggcgagggaaggatccgtacaggggcccaacactactccaccaaccgaagcccccaaaaggagcccggtgatgctgcgaaggctgtgaacaggggaggcggcactgtg

SEQ ID NO: 1379 - DNA, 255 bp, Homo sapiens
aatcacgcctcagccacctcccgcaagcctctcactgcctcagccacgctttccaggctggtttctggtccccatccgcggctggtccggccctgggaccgaatcacttcccagcgagaggaaggtcaaatttctcgaccggctacgggaaggtcgcggccgccgccctgtcagccgcctcggcgcccccaggacccctcgggtctctttaaccggaagcggaagtgcgtgtcggcgggatcatggcgactttgg

SEQ ID NO: 1380 - DNA, 255 bp, Homo sapiens
ggctccgttccatccttctgcacagggtatcgcctctctccgtttggtacatcccctcctcccccacgcccggactggggtggtagacgccgcctccgctcatcgcccctccccatcggtttccgcgcgaaaagccggggcgcctgcgctgccgccgccgcgtctgctgaagcctccgagatgccggcgcgtaccgccccagcccgggtgcccacactggccgtcccggccatctcgctgcccgacgatgtccgc

SEQ ID NO: 1381 - DNA, 255 bp, Homo sapiens
aagcagtagctacccgcgggagcggggaggggtccgggttcgagcttgtgttcccccggaagggtgagtctggacgcgggcgcggaaggagcgcggccggaggtcctcaggaagaagccgcggggactggctgcgcttgacaggctgcacttggatgggagcacctggtgcctcgggactgctccgatgcccgggtctgtgctgaatgtgtaatatgcggaactatattgaaacattacaaccatcttttgatgg

SEQ ID NO: 1382 - DNA, 255 bp, Homo sapiens
ctttccgccctctccccgcctccttttcgggcgtcccgaggccgctccccaaccgacaaccaagaccccgcaggccacgcagccctggagccgaggccccccgacggcggaggcgcccgcgggtcccctacagccaaggtccctgagtgccagaggtggtggtgttgcttatcttctggaaccccatgcagccagatcccaggcctagcggggctggggcctgctgccgattcctgcccctgcagtcacagtgcc

SEQ ID NO: 1383 - DNA, 255 bp, Homo sapiens
gcgtgcgcaatgggccacagaaccgccatgccggaaccgcgcgggtcgtcgcagctgcgggtgaacgcggcgtttgccgcgcggtacaaccgctaccgggagcgcgaggaactgcagcggctgaaggatcgctacggggaccgagacagcagcagcgactccagctccgagtcggactcaagcgacgagcgcgtggaatttgatccccagcaggagcgggacttttacaaaacgctctccttgttgaagaagaag

SEQ ID NO: 1384 - DNA, 255 bp, Homo sapiens
ggctcagctgggaggcgggacgaattattggttgggggaaacccacgaggggacgcggccgaggagggtcgctgtccacccgggggcgtgggagtgaggtaccagattcagcccatttggccccgacgcctctgttctcggaatccgggtgctgcggattgaggtcccggttcctaacggtgggatcggtgtcctcgggatgagatttggcgtttcctcggggctttggtgggatcggtgtcctcaggatgagat

SEQ ID NO: 1385 - DNA, 255 bp, Homo sapiens
ctgtcaatcaggcgcacggctggcagtagggtgccaggttcaaagagcccgcggcgtcttcacgcccctgcgctcagctctagactcagtcgctcgctgagagacgccctggaacgtctgtgtagcctcagtcgctgagagacgccctggaacgtctgtggcagcctctgtcacagtgggacccgcactggcagcgggaggcagagggaggaccctggaacatcccggaagccgggaaatggacgcagtggcctt

SEQ ID NO: 1386 - DNA, 255 bp, Homo sapiens
cccggccgggtctgggggcggggcgtttgcccggcctttccagggccggggaaccccaggaggaagctgctgagccatgggcgcctacgcgcgggcttcgggggtctgcgctcgcggctgcctggactcagcaggcccctggaccatgtcccgcgccctgcggccaccgctcccgcctctctgctttttccttttgttgctggcggctgccggtgctcgggccgggggatacgagacatgccccacagtgcagcc

SEQ ID NO: 1387 - DNA, 255 bp, Homo sapiens
ggcatttcggtgatcgggttggaactattgaagcccgctttcaggttcttttccccattttccctttgaaaggaagacttctggcttctcctaaatctccgttctctgggtaaggggagtccaagcctctgtcatgaggaacggaaatgcgagggcctcgggtgttactctaaaatccgccctcagcttgcacgccggaagctgcgattcctgcagcggaagaggcgtgatctggccttcgactcgctatgtcca

SEQ ID NO: 1388 - DNA, 255 bp, Homo sapiens
aatttagatttgcttttcccagcggggaagggaccggatctgaaaggagatgctctctgattcctaaaagggtgggggctggctgggcgcggtggcgcatgcctataatcccagcattttgggaagccgaggcgggtggatcaagagaagaggagttcgagacaagcctggccaacatgatcgagaagaagctggaaccactgtcacaggatgaagaccagcacgcggacctgacccagagccgccgcccactta

SEQ ID NO: 1389 - DNA, 255 bp, Homo sapiens
tgctgctccgccgcgtcccactcttctcgctccgctttcgccccgcatcttccaccttccttccagtccttgcggcgaccgagcccgcagtgtcagtccccagcggggacctgagtatgccggtgaagacgagagcggaaggcgaggacgacggcttcggggaagcgggtgacccgaggagactgctggagcgaccttggcgtttccgggggtgccttcccgggaaggggaatcgggatgttggcttcgaaggga

SEQ ID NO: 1390 - DNA, 255 bp, Homo sapiens
tttttttttttttttcctaatttttggtcggcggcggtgctgggccaggggaaggaagggacacggaggccgccctcgtcccgccacctcctacccgcttccccccagccccggctccgggagatgtgccgggcggggggcccgggttcgccgagccgcaggagagacacgctgggccgaccccagagaggcgctggacaggctggtggtccaggccgtggtgcctgccaggtgatgtggggcaaagccccccgc

SEQ ID NO: 1391 - DNA, 255 bp, Homo sapiens
ctgactgaggggtcagtggttccgggtaggagctaggtgaccctcggctgctgcagggatctgcagcgactgcagccatgggggcccacctggtccggcgctacctgggcgatgcctcggtggagcccgaccccctgcagatgccaaccttcccgccagactacggcttccccgaacgcaaggagcgcgagatggtggccacacagcaggagatgatggacgcgcagctgaggctccagctgcgggactactgcg

SEQ ID NO: 1392 - DNA, 255 bp, Homo sapiens
gaggtgcgctgaacgcatgcgtgctgtggtcgcctagtaaacggggctgctggtgggccgcgtcgaagacatggaccagggctacggaggctacggggcgtggagtgctggacctgccaacacccagggtgcatatggaactggtgtggccagctggcaaggttatgaaaactacaattactatggcgcccagaacaccagtgtcaccacaggcgcaacctacagctacggcccagcctcgtgggaggccgccaa

SEQ ID NO: 1393 - DNA, 255 bp, Homo sapiens
gtgtgtggaggggaccctgtggttagcagcagctatcgcagcgtcggatgttcagagcagcagaagccggcgtcgtcggatgttgtgttgcccgccaccatgagctacacaggctttgtccagggatctgaaaccactttgcagtcgacatactcggataccagcgctcagcccacctgtgattatggatatggaacttggaactctgggacaaatagaggctacgagggctatggctatggctatggctatggc

SEQ ID NO: 1394 - DNA, 255 bp, Homo sapiens
gttgcccagggcaaccgctccttcaggcgtgaatgtggcggctgcctctgcgaatggacggcgtgggaagagaatggcttctgcaaggaaagccagccgtcccatgcgtgatgtttttggtgacttcagtgatgtttccttggaagattcaacaatggaagaaatcagaaacttccagatcagtagaaatcttaccaaaatagcacctggtcatagcagatttctaaaaagaaaccaaactctagatgagaaaca

SEQ ID NO: 1395 - DNA, 255 bp, Homo sapiens
cccccagctgggacggcccaggcgcctataaagggggtccccgcttggccccggcgccacccaccaccatggacccccgtctgcccgcctgggcgctggtgctgctgggccctgccctggtgttcgcgttgggccccgcgcccaccccagagatgcgtgagaagttgtgcggccaccacttcgtacgcgcgctagtgcgcgtgtgcgggggcccccgctggtccaccgaagccaggaggcctgcgaccggaggcg

SEQ ID NO: 1396 - DNA, 255 bp, Homo sapiens
ggtggctgaacctcgcaggtggcagagaggctcccctggggctgtggggctctacgtggatccgatggagccgctggtgacctgggtggtccccctcctcttcctcttcctgctgtccaggcagggcgctgcctgcagaaccagtgagtgctgttttcaggacccgccatatccggatgcagactcaggctcggcctcgggccctagggacctgagatgctatcggatatccagtgatcgttacgagtgctcctg

SEQ ID NO: 1397 - DNA, 255 bp, Homo sapiens
cagagaggctgcagacagagaaggatgatggcgtctgcggcagcagcggaggccgagaagggatctccagttgtggtgggcctgctagttgtgggcaatatcattattctgctgtcaggcctgtccctgtttgctgagaccatatgggtgacagccgaccagtaccgtgtatacccactgatgggagtctcaggcaaggatgacgtcttcgctggtgcctggattgccatcttctgcggcttctccttcttcatg

SEQ ID NO: 1398 - DNA, 255 bp, Homo sapiens
agacttcctccttcacttgcctggacgctgcgccacatcccaccggcccttacactgtggtgtccagcagcatccggcttcatggggggacttgaaccctgcagcaggctcctgctcctgcctctcctgctggctgtaagtggtctccgtcctgtccaggcccaggcccagagcgattgcagttgctctacggtgagcccgggcgtgctggcagggatcgtgatgggagacctggtgctgacagtgctcattgcc

SEQ ID NO: 1399 - DNA, 255 bp, Homo sapiens
gttgtggttattgagttaagcctggcgagtcgaggtgacccgggccgggctgcgggaggagctcgcggtgaggtggccccgcgctgccgggcgaggtcggtccacgtggagccgggagcctgaggcctctgtacgcgggagctgcggacgatggtgttctgcaagtgaaggccccctgaagtggaagacagcattggtactaatggccaactcaagtttcattggggatcatgtccatggagctcctcatgctgt

SEQ ID NO: 1400 - DNA, 255 bp, Homo sapiens
acttccggtaggagcctcgcaggaatggtctccgggtagaggcaggtaaggatgtcccgggccggtggagaaggaagagctgggcgtgtggcttcgcttggaatccgaatcagagcttggaccagagccttccctgagaatgctgaagcaacaccttctttggattgagtttcttccagagggaacgaagaagaggattaaataatacattcaattctaaaataagacatggcccatgagttggtgatgttcaga

SEQ ID NO: 1401 - DNA, 255 bp, Homo sapiens
gatctgcgcatgcgcactcgaggcaaggcggccactcccagaagtctccggggctcgagcggtgggtgggaggcgcggtccaagtggtcgctgccgtatttctcgtaggtttttaggattctggactccatttctcaccggtacctgcggtcctgactgttctggcttggactacatattacaaaggcaacggagaaaacttggacccctggctccggttccgggaccttttggttccacctgaagaaggcggcg

SEQ ID NO: 1402 - DNA, 255 bp, Homo sapiens
agccgggcgggcacgctccgaaccgcggcttaggtggcggcggcgaaggatgcacccggcaggcttggcggcggcggctgcggggacgccccggctgccctcgaagcggaggatccctgtgtcccagccgggcatggccgacccccaccagcttttcgatgacacaagttcagcccagagccggggctatggggcccagcgggcacctggtggcctgagttatcctgcagcctctcccacgccccatgcagcctt

SEQ ID NO: 1403 - DNA, 255 bp, Homo sapiens; identical to SEQ ID NO: 770

SEQ ID NO: 1404 - DNA, 255 bp, Homo sapiens
acagaaggaggaaggtcagcagccccgacagccgacagtcacagcagctctgacaagagcgttcctggagcccagctcctctccacagaggacaagcaggcagcagagaccatgggccccccctcagccgctccccgtggagggcacaggccctggcaggggctcctgatcacagcctcacttttaaccttctggcacccgcccaccactgtccagttcactattgaagccctgccgtccagtgctgcagaggga

SEQ ID NO: 1405 - DNA, 255 bp, Homo sapiens
gccgagccagccccttcaccaccagccggccgcgccccgggaagggaagtttgtggcggaggaggttcgtacgggaggagggggaggcgcccacgcatctggggctgactcgctctttcgcaaaacgtctgggaggagtccctggggccacaaaactgcctccttcctgaggccagaaggagagaagacgtgcagggaccccgcgcacaggagctgccctcgcgacatgggtcacccgccgctgctgccgctgct

SEQ ID NO: 1406 - DNA, 255 bp, Homo sapiens
atctttaggcgtgcgaggagggggcatggcggatactgtgttgtttgagtttcttcacacggagatggtggctgagctgtgggctcacgaccccgaccccggcccgggggtgagcgccgggctccgtggggaggaagcgggggccaccaagggacagaagatgagcctgtcggtcctggagggtatggggttccgtgtgggccaggctctaggcgagaggctgccccgggagacgctggccttcagggaggagct

SEQ ID NO: 1407 - DNA, 255 bp, Homo sapiens
ccggaagtgctgcgagccctgggccacgctggccgtgctggcagtgggccgcctcgatccctctgcagtctttcccttgaggctccaagaccagcaggtgaggcctcgcggcgctgaaaccgtgaggcccggaccacaggctccagatggaccctgggaaggacaaagagggggtgccccagccctcagggccgccagcaaggaagaaatttgtgatacccctcgacgaggatgaggtccctcctggagtggcca

SEQ ID NO: 1408 - DNA, 255 bp, Homo sapiens
cgcgcgctgcagtgccttccccacctcggccccgcccgcccccgccgagccgagcaccagggcggcggcggcggcggcggcggcggcggcggctggagcagcccgggaggaggaggcggcgagaatggcagcggcgtcgtgggcgcggcggagatgagcgcccgcgaccccgggcccagggcggcacagccggagtgggcgggggtcccgatgcaggcccgaggggggccatggggcaggtcctgccggtcttcg

SEQ ID NO: 1409 - DNA, 255 bp, Homo sapiens
ggaaatgaagggtctgctcgccgtagtatggaggcgggcagaatgccgctcgcacgggacgaggcatgggcggggtcgggctgtgctctggactccatttcccggcggccctgggtgtgtggcgcgtgcgcaccgttcccggcgacgaacggaagatggcggcggcggcggcggcggagtgtaggaagaggcactgctgagggggcgcgaggggaacggaggccagagctgcgctgacagcagccatggcgagcg

SEQ ID NO: 1410 - DNA, 255 bp, Homo sapiens
acggcggggcgaagcgcccaggggcctgtgcgtccctccctgctgagcgagggggcctgtcattgccgtgggcgtgacccagaccccaaccacagtgcatcccgccctggcccagccagagaaggaagctgagtctggggtctgctgggccagcaggaagtcccagcagggtgtgaagcaagactttccgggccactcctggaatcccccagcagataaaggcggcccctccaccgggcgctcctagcggtctcc

SEQ ID NO: 1411 - DNA, 255 bp, Homo sapiens
tttccggtgtcggggcacagttgaagaagcgaccgagggactgggagtcgttagtgagagtttcactcttgttgcctaggctggagtgcaatggtgcgatcttggctcatcacgaccttcgcctcccaggttcaagtgattgtcccatttcagcctcccgagtagctgggattacaggatgacgcggcatggcaagaactgcaccgcaggggccgtctacacctaccacgagaagaagaaggacacagcggcctc

SEQ ID NO: 1412 - DNA, 255 bp, Homo sapiens
ccgaggaaccgaccgccgccggccgggttgcaggcggggcacctcgggcaggacctccctggtcggaagtggccgtgagcccaagccgcggtcccgggccggcacccaggatgggcgaggtggaggccccgggccgcttgtggctcgagagcccccctgggggagcgccccccatcttcctgccctcggacgggcaagccctggtcctgggcaggggacccctgacccaggttacggaccggaagtgctccagaa

SEQ ID NO: 1413 - DNA, 255 bp, Homo sapiens
tcatgtgacaaagcgcaggacccctcactgccccaactgcttgctgttctctctttcttgggctctaaggacccaggagtctgggtgcacagcctccttctctctgagattcaagagtctgatcagcagcctcttcctcctccaggacccagaagccctgagcttatccccatggagctctgccggtccctggccctgctggggggctccctgggcctgatgttctgcctgattgctttgagcaccgatttctgg

SEQ ID NO: 1414 - DNA, 255 bp, Homo sapiens
aatcattagagcctgagtcactctccccaggagacccagacctagaactacccagagcaagaccacagctggtgaacagtccagcctgtctccagttggactagccacaattcaagtgcttgaaaaccacatgtggagcagacaagatggagacaaattcctctctccccacgaacatctctggagggacacctgctgtatctgctggctatctcttcctggatatcatcacttatctggtatttgcagtcacct

SEQ ID NO: 1415 - DNA, 255 bp, Homo sapiens
aggcctggtttctgtcctgcgcgcgcagattcgcgcagaccaggaagcggatcccgtggaatgacggtcacgccgcggcgggcggattgacttctaaagaatcttggtacgtgaggaagaaacccagaagaggaagaggaaagcaaaggagtcagggatggctcttcctcagggtctattgacattcagggacgtggccatagaattctctcaggaggagtggaaatgcctggaccctgctcagaggactcttta

SEQ ID NO: 1416 - DNA, 255 bp, Homo sapiens
gctctagcgggtatctgcccaccatggccctggtgctgatcctccagctgctgaccctctggcctctgtgtcacacagacatcactccgtctgtggccattatagtccccccagcttcataccaccctaagccatggctgggagctcagccggctacagttgtgacccctggggtcaacgtgaccttgagatgccgggcaccccaacccgcttggagatttggacttttcaagcctggagagatcgctccccttc

SEQ ID NO: 1417 - DNA, 2608 bp, Homo sapiens
taaggactcgactacctccgaagaaagccgaaacatgtggctccgcccacagtggcctcagctctccgttctcgactattgccgaagtgagccgaagtttgtggccccgcttccggagaactcaagctcccgattgtgcccgaaggaacccgaagggagaccccgcctcattcctcacgccgagctccagaccccgcctcctttccagagcccgtctgttccccttcgggtccaaagcttttggctcctccttgttccgagcccgaaggcccgccccttcacgtactcggagctcggatcccagtgtggacctggactcgaatcccgttgccgactcgcgctctcggcttctgctccggggcttcttccctgcccgcccggggccctgaccgtggcttcttccccggcctgatctgcgcagcccggcgggcgcccagaaggagcaggcggcgcgggggcgcgctgggcgggggaggcgtggccggagctgcggcggcaagcgggctgggactgctcggccgcctcctgcccggcgagcagctcagaccatgtcgcctgaagaatggacgtatctagtggttcttcttatctccatccccatcggcttcctctttaagaaagccggtcctgggctgaagagatggggagcagccgctgtgggcctggggctcaccctgttcacctgtggcccccacactttgcattctctggtcaccatcctcgggacctgggccctcattcaggcccagccctgctcctgccacgccctggctctggcctggactttctcctatctcctgttcttccgagccctcagcctcctgggcctgcccactcccacgcccttcaccaatgccgtccagctgctgctgacgctgaagctggtgagcctggccagtgaagtccaggacctgcatctggcccagaggaaggaaatggcctcaggcttcagcaaggggcccaccctggggctgctgcccgacgtgccctccctgatggagacactcagctacagctactgctacgtgggaatcatgacaggcccgttcttccgctaccgcacctacctggactggctggagcagcccttccccggggcagtgcccagcctgcggcccctgctgcgccgcgcctggccggccccgctcttcggcctgctgttcctgctctcctctcacctcttcccgctggaggccgtgcgcgaggacgccttctacgcccgcccgctgcccgcccgcctcttctacatgatccccgtcttcttcgccttccgcatgcgcttctacgtggcctggattgccgccgagtgcggctgcattgccgccggctttggggcctaccccgtggccgccaaagcccgggccggaggcggccccaccctccaatgcccaccccccagcagtccggagaaggcggcttccttggagtatgactatgagaccatccgcaacatcgactgctacagcacagatttctgcgtgcgggtgcgcgatggcatgcggtactggaacatgacggtgcagtggtggctggcgcagtatatctacaagagcgcacctgcccgttcctatgtcctgcggagcgcctggaccatgctgctgagcgcctactggcacggcctccacccgggctactacctgagcttcctgaccatcccgctgtgcctggctgccgagggccggctggagtcagccctgcgggggcggctgagcccagggggccagaaggcctgggactgggtgcactggttcctgaagatgcgcgcctatgactacatgtgcatgggcttcgtgctgctctccttggccgacacccttcggtactgggcctccatctacttctgtatccacttcctggccctggcagccctggggctggggctggctttaggtgggggcagccccagccggcggaaggcagcatcccagcccaccagccttgccccggagaagctccgggaggagtaagctgtcacgacgctccctctgccagctggtcccgggaattctgtgaaccaggctgctgtctcctccccagaaagagtccttaccttggagagggtcctggagagaatttcctcttccccagctaaataccctgcctgcaactgaagcagacccgggggtgtcctccctgccctctgcccagaggccacctccactcctacaaaatcaaagtattgtccagacaagagtcactggcccctgctccagcttctgggtatccagagagcactgcacttccccaaaacggaaggggcccctgggcagtgggttttgggcaaattccctttctttgcatccacaatgtggggtcggagcttgggggcaggtcctgggagtgggaagcctcttccttgtgtctttcgctccacttttagctcatcgcaccaatattgcagacttggaaggaagcataagcttcccatttcacaaaggggaaactgaggtgcgggtgcgcgggcctggggacggccgtcccatggcttccatctgagccacctcgggaccccagcactcctggcgccctcttctcatcgcttggcctatgacaggtcaccgtgtgtaaatctttcccaataaagtgttgcacaaaggcaaaaaaaaaa

SEQ ID NO: 1418 - DNA, 255 bp, Homo sapiens
atgcagctcagcctgggctacacagccaggtgtcagatgtgtctctgctgatctgagtctgcctgtggcatggacctgcatcttccctgaagcatctccagggctgaaaaatcactgaccatggcaccatggtctcatccatctgcacagctgcagccagtgggaggagacgccgtgagccctgccctcatggttctgctctgcctcgggaacctctccaaagccaccctctgggctgagccaggctctgtgatc

SEQ ID NO: 1419 - DNA, 255 bp, Homo sapiens
ctacgggcaccgtggccacacctgcctgcacagccagggccaggaggaggagatgccatgaccctcattctcacaagcctgctcttctttgggctgagcctgggccccaggacccgggtgcaggcagaaaacctacccaaacccatcctgtgggccgagccaggtcccgtgatcacctggcataaccccgtgaccatctggtgtcagggcaccctggaggcccaggggtaccgtctggataaagagggaaactca

SEQ ID NO: 1420 - DNA, 255 bp, Homo sapiens
atgttggtgaccttcaaggatgtggctgtgacctttacccgggaggagtggagacagctggacctggcccagaggaccctgtaccgagaggtgatgctggagacctgtgggcttctggtttcactaggtgacagagcacaagttcataccagagagccaaccacttacccgccagtcttatctgagcgggcctttctccggggaagcctgactctggaatcttcaacctcaagtgattcgaggttggggagagct

SEQ ID NO: 1421 - DNA, 255 bp, Homo sapiens
tggttctctacctcggcccacgccgcctgagttagaaacgctgcctccggcacagagcgggggtcgccccgctgcgcatcagccggtgggtcgctggcgctggtggcagccgtgcctgggttcccgccccgggtcgcccgccgctcccggccccgctccgctcacaatccgatggcggcggccgtgcttagggattcgacttcggttcccgtgactgcagaagctaaacttatgggctttacacagggctgtgtg

SEQ ID NO: 1422 - DNA, 255 bp, Homo sapiens
ggcgggacttccgttgtcctccttgtggcggtcgttttggcatttgtctggactgattacttggtagaaagccccggagcgctgggtcagcatcatccgtgactgactgagaaggcgcgagaggagtcttccccgctgcacagaggcgtggctgaggctcggcggcgcccagggtacccaggcccggcccggaataaggacatcctctctggccccgctccgctcacagagtcagatggcggcggccgagctgac

SEQ ID NO: 1423 - DNA, 255 bp, Homo sapiens
ccggaacatggctgccgccggccgccaaccggtcttgctgtctcacccaggctggagtgcagtggcacgatcacagctcactgcagccttgagctcctgggctaccaagtagctgggacttcagagatggctggagccgtgtggatgggcataaatggctaatgtccagcaaccatcgatgtcaagtatccacacacctggcctgaatggatccctctgcctttcagagtttgggatatgagattgaaaatgacg

SEQ ID NO: 1424 - DNA, 255 bp, Homo sapiens
cgcggctgagcctctttgtctgagcgcgctcggcttttttttttttttctctctccttccctgcagcagtggccggtgtccagctgcctactttctgcccggatctctggctcctcatctctccggtctccgcagactaaagccctcgggatatgcagcagccatgcctgtgcacacgctgagccccggagccccgtccgcccccgccctaccttgccgcctgcggaccagggtccctggctacctgctacgggg

SEQ ID NO: 1425 - DNA, 255 bp, Homo sapiens
cagacccacctttgagagggcacttcctactttctgttgtgtttggaatgcaaagatctggctgaaacggtggccacggagaaggggtgatagatttgagaggctggagggatgaggaagtgaggaactctacatactgagctctcaagcctaggagtgaaaacgggtcgttcagattctaggagataagtttccatgcactttggtggcacagaaaattgaccgtacaggggcccgtgctggttgaggacactt

SEQ ID NO: 1426 - DNA, 255 bp, Homo sapiens
gcagccagtcgcggaggcggggaggctgcgcggtcagaggcgcctggagcgagcgaatcctggcccaccgcctgcccaaccgcgtgaccttgattgagttaatgaacttcacgcctcagcgtccaggtctgtaaaatggggtgtctaacgcagaccgtacagcccagctgggtttagcaaacttccgggagccagttggagcctctccccatccctagcggtgatcccaggtgacgacatgccgcggggggtcct

SEQ ID NO: 1427 - DNA, 255 bp, Homo sapiens
tgctccggcggcttcgctgctagctcgcggcgacgtcgggccgattttcccaggatgacagagctgaggcagagggtggcccatgagccggttgcgccacccgaggacaagataattggagggtccaccatcactttgtcgcctgctcaatggttggctggagctgaggatcatcggttcccaccaatccctgttgccttacaccaggctcacggcttcccctaatgcagcctgtaactttttgatgactggacg

SEQ ID NO: 1428 - DNA, 255 bp, Homo sapiens
ataagtggagtgtgctggggtgtgtaaagtagtatggaggcagcggtagcccagtgtctgagtggttgccgggtctccatggagaagcggctcgccagtgtcccaggctgctgagctctcgccgcccgagaccccgcggcgcggccgcagggccatgctagccttgcgcgtggcgcgcggctcgtggggggccctgcgcggcgccgcttgggctccgggaacgcggccgagtaagcgacgcgcctgctgggccct

SEQ ID NO: 1429 - DNA, 255 bp, Homo sapiens
gaggggtcgagcctgggcagtacaggcggcggtgcgcactctgcggcggcctctgcgcctcgggcgggcgggagagagaggccgcggccgccagcgtggggatgtctaggagctcgaaggtggtgctgggcctctcggtgctgctgacggcggccacagtggccggcgtacatgtgaagcagcagtgggaccagcagaggcttcgtgacggagttatcagagacattgagaggcaaattcggaaaaaagaaaaca

SEQ ID NO: 1430 - DNA, 255 bp, Homo sapiens
gagcatacgtcatcgttctcgctttccggtagctaaggcgatcagcgggacttcccactgagacgagcggatgtcatattgtatcagggcgaacctctgaggagcgctggctgcgcttaggcaacggtgcggcaggcgccggggttttctgaaacagaaacgtttaggggtggggaaacgtgttccgaggaactctcgttttgaagtgcgacatacacctgtcttgccctgttccaagatggtggcagagcttct

SEQ ID NO: 1431 - DNA, 255 bp, Homo sapiens
gcgacgaggagggcgacgacgaggagacgggcagcggcgaggaggaggaagaggaggcggaggcggcggccgggtgggagcgcagcgaggacgcgcggctgctgcgcgcagggctgcctcctgccgctgtccccgccgcggccgcccgcgacaggagcggccgccgcccgccgaggccgccgcccggccgcccgaggatgcggccgtccggcgacgaggaccgcgcgcgtcgccgccgccgccgccgccgccgga

SEQ ID NO: 1432 - DNA, 255 bp, Homo sapiens
ggagttagcctcgctcagggcgcggctaaggcgcccagatggcctgcgggcgccaccacgtccctggtcccagctcgggagcacatcagaggcttagaggcgagtgggaagggactcagacagtgcaggacgagaaacgcccgcggcaccaaagcccctcagagcgtcgcccccgcctctagttctagaaagtcagtttcccggcactggcaccccggaacctcaggggctgccgagctgggggggcgctcaagc

SEQ ID NO: 1433 - DNA, 255 bp, Homo sapiens
cacacccacggcagacacgcacgcacccgggcgccgaagggaaagccgcgtctcgccctcccgccccgccgtcggtcctgtctcagtccctcagcagagcgggaaagcggaggccggagccgtgacctctgaccccgtggttatgcggagccgccgcattccttagcgatcgcggggcagccgccgctgccgccgtgggcgactgacgcagcgcgggcgcgtggagccgccgccgcccctcccccaccgccgctc

SEQ ID NO: 1434 - DNA, 255 bp, Homo sapiens
actcccccactcaccaggccccgcccctctacggaggccccgcctctagttcggcctgttttctcagtcccggcacccgccgcgaccgcaaaggcggccgcggttctaggaacttgacgtgatggggcttcctgaggagcgggtccggagcggcagcgggagccggggccaggaggaagctggagccggaggccgggcgcggagttggtctccgccgcccgaggtcagccgctccgcgcacgtcccctcgctgca

SEQ ID NO: 1435 - DNA, 255 bp, Homo sapiens
ctttttcctttcctgattccttgtgtatgtgtggctgggccgcccctcttctcggctcagagtcacggagtgccttgaactaggcccacctcgccggggcggctggttctctgtttgtgggacgctggtgtctctggaggcccttcctgagaagccgtcgccagagttacgtcgcggttttcttaactttagagcctgggggccggagaccctgattgcactcgacctggctctgccctactctctgcgtgactt

SEQ ID NO: 1436 - DNA, 255 bp, Homo sapiens
gtgctttccagccgcgagctgtcaggccgagtgtcaggccgggcaggtacgcggcgcgcgcccccggcgccccccgctccccgccgggacgccccgcgccgagccggaggccgcgtggacccgaaagccgctgggaaaagtttacccaaggtccagcctagcccctaggcaccatgtcggacagtgatctaggtgaggacgaaggcctcctctccctggcgggcaaaaggaagcgcagggggaacctgcccaagg

SEQ ID NO: 1437 - DNA, 255 bp, Homo sapiens
gggcgcgcgacactgcaccgcccctcccttcgcggcgcctgctctgtagagccggcggaaccgggtagcttggccaggttgtgaggaaccgcagcgcgccgcaggaccgggccgctgagcctgcagccgccccgcgccgtgacctgcgaccctagaccccgactccctttggctcagcccgcgcgccccaggcccggcccgggcggcgcgacgggaggatgagcggcgggcggcggaaggaggagccgcctcagc

SEQ ID NO: 1438 - DNA, 255 bp, Homo sapiens
ggtagctcccggaataggagcgttgcgagacggtcggttccaagtgggcctgggcgcgggggagaggcgggtctgtcctcgggaactgcaaggccctgtgagcgggaggactgggatcccggccgcggctgctggaagcgtcgaagctcagcggggccgcggacactgacctgtgcttagaactcatcctggcccgcagagcctgccgcgagtccctggcgtcccctgtggcgggctcttggagccactttcccg

SEQ ID NO: 1439 - DNA, 255 bp, Homo sapiens
gtccttttaccgcggtgtggccggctcgcttgtcgctcgcacttttgccctattggctctgcggctccgctcgccgcactttacggcagtgtggctggagccgcggctgacgggcccgcggtctgggcgtgagtgcagggaagtggagtatttgctgggccgggtaccatggacgtgggcgaacttctgagctaccagcccaataggggcacaaaacgtccccgggatgatgaagaggaggagcagaagatgcgt

SEQ ID NO: 1440 - DNA, 255 bp, Homo sapiens
ggcggggctggacgcgcgctccaagatggcggcgaacgtgttcccgttccgcgacgcccgtgccgcaccggacccagtgctggaggccggcccggtggcacacgggccactgccggtaccgctggtgctggacaacgggtcgttccaagtccgcgctggctgggcgtgtcccgggcaggacccaggtcccgagccgcgcctgcagttccgcgcggtgtgcgcccgcggtcgtggcggggcacggggcgcgtcggg

SEQ ID NO: 1441 - DNA, 255 bp, Homo sapiens
ctctgtcgccgctggagcagctgcggctcggggacccacagacacagccggggtcgggagccgcccggggcagggctcgggagagcgggccacaccatgaggccccagccccaccagaggccccgcgctgccctggcccccggtgcaccgtgctagcccccagccagggcgttggggagggcggtggccatggccagtcacgtggacctgctgacggagctgcagctgctggagaaggtgcccacgctggagcgg

SEQ ID NO: 1442 - DNA, 255 bp, Homo sapiens
ggagctagcctcgtgaccttttaccccaacatggctgcgcccgtgggaccggtgaagttctggcgacccggtacagaggggccaggtgtaagcatctctgaagagagacaaagtctggctgaaaactctgggacaacggttgtttacaacccttatgctgccctttccatagagcagcagaggcagaagctgccggtattcaagtaccttgcagaagccggctggacagctgaaggaagagtggtaggagtgacc

SEQ ID NO: 1443 - DNA, 255 bp, Homo sapiens
gagccgccgccgggtcccgctcgtctgccgcctcagcctcagccccaacctcagccgccgccgttgcgcttgctcccgggcggtcctggcctgtgccgccgccgcccccagcgtcggagccatggcgggcgccgcgtccccttgcgccaacggctgcgggcccggcgcgccctcggacgccgaggtgctgcacctctgccgcagcctcgaggtgggcaccgtcatgactttgttctactccaagaagtcgcagcg

SEQ ID NO: 1444 - DNA, 255 bp, Homo sapiens
actcaggcccctcccccggcgcccgcgcgccaggactgggcggcgccgacgcgcttggcgggagatagaaaagtgcttcaacccgcgccggcggcgactgcagttcctgcgagcgaggagcgcgggacctgctgacacgctgacgccttcgagcgcggcccggggcccggagcggccggagcagcccgggtcctgaccccggcccggctcccgctccgggctctgccggcgggcgggcgagcgcggcgcggtccg

SEQ ID NO: 1445 - DNA, 255 bp, Homo sapiens
cactacgcctgcgcaacctcagccccgcccctccgctgctttccccggaaacgtttctttcctacgcagccgctcctgccgccgtggtcgctggagctttgcctctctaggccggcagcgcctctcctccatggtcctgtctgtcagcgctgttttgggagcccgccggtgaggccgggccacgctcagacacttcgatcgtcgagtctgtcactgggcatggcgggtcagttccgcagctacgtgtgggacccg

SEQ ID NO: 1446 - DNA, 255 bp, Homo sapiens
agtgacgtcacggcgccactttccggccggtgacagagtccagcggagttgtgggggccgggggcgccatgggagccactggcgacgccgagcagccgcggggacctagcggggccgagaggggcggcttggagctgggggatgcgggcgcagcggggcagctggttcttacgaacccttggaacataatgataaagcaccggcaggtgcagcggaggggccgccgctcacagatgacaacaagtttcacagatc

SEQ ID NO: 1447 - DNA, 255 bp, Homo sapiens
agagtgcacccgaatccacgggctcggaggcagcagccatctctcggccatagggcaggccagctggcgccgggggctattttgggcggcgggcaatgatggtgaccgcaaggcgaccttgtaaggcatttcccccctgactcccttccccgagcctctgcccgggggtcctagcgccgctttctcagccatcccgcctacaacttagccgtccacaacaggatcatctgatcgcgtgcgcccgggctacgatct

SEQ ID NO: 1448 - DNA, 255 bp, Homo sapiens
agacacctctgccctcaccatgagcctctggcagcccctggtcctggtgctcctggtgctgggctgctgctttgctgcccccagacagcgccagtccacccttgtgctcttccctggagacctgagaaccaatctcaccgacaggcagctggcagaggaatacctgtaccgctatggttacactcgggtggcagagatgcgtggagagtcgaaatctctggggcctgcgctgctgcttctccagaagcaactgtc

SEQ ID NO: 1449 - DNA, 255 bp, Homo sapiens
atgcgcactcttaagaggtcgaacggggagggcggcaggggctctggaacggaagtgacgcatggtacttgcgcaaagacgacgaggaggctgcgaaaagttaagggccggaccgcaggctgtgctcgcttccggaagtggcttctgcgacaacatgcttgcggacctcggcttaatcggaaccataggcgaggatgacgaggtgccggtggagcccgagtctgactccggggacgaggaagaggaggggcccat

SEQ ID NO: 1450 - DNA, 255 bp, Homo sapiens
ccgaaagccccgggagagactaagaagcaatcctcccacgcgctttctcccaccctcgggccactgagacggagggacagagggccgccctcgcgcggccgaggccccgcctcccgctcgcccgcccgcgcctccagcggaagccggaagcaaaagcgggtcctgctagccccgcggctccgaactcggtggtcctggaagctccgcaggatgggggagaagatggcggaagaggagaggttccccaatacaact

SEQ ID NO: 1451 - DNA, 255 bp, Homo sapiens
atcggccgccgttgcgcggcgcagagcggcagcaagatggcggcgcaacagcgggactgcgggggtgctgcgcagctggcggggccggcggcggaggctgaccccctaggacgcttcacgtgtcccgtgtgcttagaggtgtacgagaagccggtacaggtgccctgcggacacgtcttttgctctgcatgcctgcaggaatgtctgaagccgaagaagcctgtctgtggggtgtgtcgcagcgctctggcacct

SEQ ID NO: 1452 - DNA, 255 bp, Homo sapiens
ccttctgcttcaggggcggagcccctggcaggcgtgatgcgtagttccggctgccggttgacatgaagaagcagcagcggctagggcggcggtagctgcaggggtcggggattgcagcgggcctcggggctaagagcgcgacgcggcctagagcggcagacggcgcagtgggccgagaaggaggcgcagcagccgccctggcccgtcatggagatggaaaaggagttcgagcagatcgacaagtccgggagctgg

SEQ ID NO: 1453 - DNA, 255 bp, Homo sapiens
gtgtgtgtgtgcgagggtgtgtgtgtgtgtttgtgtgtgtgtgcatatgtggggggtgtgagtgtgtgtgtgcgaggaagcgggggtgcgtgcgcgtgtgagtgcgtgtgtgagtgtctgtgtgtgtgtctgtgtgtgtgtgtgagtgagtgaattccagattttctgtctttccaaaacccgctcctgtcctctcgcatatcactcacagacggggatctgacagcagccacaaacctacagtgagtgatcgct

SEQ ID NO: 1454 - DNA, 255 bp, Homo sapiens
aaagtccaagaggacggaatgtggagacagtgttgtatttttgcggggagttctaggccgaccgggagcgagagaacgctcgggggcgaagcgcgccattgcggccctccccgccgcctgcggtagtccagtcccaagatggcggccaccatgaagaaggcggctgcagaagatgtcaatgttactttcgaagatcaacaaaagataaacaaatttgcacggaatacaagtagaatcacagagctgaaggaagaa

SEQ ID NO: 1455 - DNA, 255 bp, Homo sapiens
ggcaggattcgcgcctccatttttccaggagagagcgggataccaagagaaccggaccagctggtactgggacacggggagagtagctggtgcggtcggctggggcatttagagaaaaccacagaaacgactggggcgagactggaagagtcgagagttagcaagctggcagggaaactgtcttccttttctccaagatgtacagaaccaaagtgggcttgaaggaccgccagcagctctacaagctgatcatta

SEQ ID NO: 1456 - DNA, 255 bp, Homo sapiens
gaagagtggtgtttttttcttcttcttcttcttttgtggtttcacatagcaaatgagtgacagtctctacttacagacaaagtgagacgtcaggcattgagacatagctccatagaattcagtttctgagaaccagccagaagcatgcagtgacattgcacaatctgcctctgaagctggagatactagctgcagagctcaggggagctgctccacatcaccgacatgaagggaacaggcatcatggactgtgcg

SEQ ID NO: 1457 - DNA, 255 bp, Homo sapiens
aggatagaccaaggaagaggggctggggggcagcctgggggcatgaaaagtggccaggaaggagccaagactccaccagcaacaattgagttgcttcagcctcagtctagggttccttccaggccttgaaccccccaacctcacaagggttggaaagtgaggccggtgaactttccagctggtactttgattttaaaataataataataattttttcaccctagttcggttgggtgctccatcttacggagcccc

SEQ ID NO: 1458 - DNA, 255 bp, Homo sapiens
agctcagccagggagctcagcggagctgcgcgcctccgcctccagctcccctgccgcagcgcgccgcagccgggcgtccccgcgcgggcgccggagaggaaggaaggctggcagcctcgtcacgtgtccgctgcagtcgcgaaacagttccggtggtgaggagacctttccaaatataagaggaataaagaagtcacctccccagctgtcatcatcttccagcagattgagcaagaatattttgagcactacagg

SEQ ID NO: 1459 - DNA, 255 bp, Homo sapiens
agaccccagccagtcttttgtgtacgtgcaggaccatggtggctttagtttctaccccacccttcctaggaactctacttgtggcaaacgtatgttcaagcttacaagtcagcccaccccactctgataaatgcaagaaaagctgaaaagggaggagcaagatgggatgaaagcatctgggccaaagtgacctgaaaacctttagagaagaagctgctggctgagaaggaggtgtgtggctccggtgagaccacc

SEQ ID NO: 1460 - DNA, 255 bp, Homo sapiens
agtgccctctgtcatttaatctccacggagtcctgaaggtgcttcccaggtttgtccccatcacacagatgaggcaatcgttctgttaagactgtccttgggtcattatgtcagcaatgaaatcggtgctgccattactaaacccttactgtgtgctggcatttgtgtatgcatgcatgtgtgtgcgtgcacacgtgtgtgtttgcgtgtacatgtgcatgtgtgtgttgtgtgcctgtgtgtgcacatgtagaa

SEQ ID NO: 1461 - DNA, 255 bp, Homo sapiens
agatgctcccaggctctcccgcagtttaaagacttaactcagcggctttcagggcctgtggttgagggactccgaaagaactgttgctggtggaccggttcagggtcttgacttcgccacacaaaagaacttgagagcacgtccaaagtaaagctaagacctctagtacagtgttcaatggaactggtgagaaaagacgtccttgctgtgttcctgatatgaagaggaaagcagtccttctccattaagtaaaat

SEQ ID NO: 1462 - DNA, 255 bp, Homo sapiens
gtgagaccttgcaaagcgcaacgtagccggaagctggtggcggctggtgggcgaccgggcgcatcctcattgcagtgcggcggccctacctcggccctggcctgaccccggcggccctgcccgcccctccctccagcatcatggccagcccaagaaccaggaaggttcttaaagaagtcagggtgcaggatgagaacaacgtttgttttgagtgtggcgcgttcaatcctcagtgggtcagtgtgacctacggca

SEQ ID NO: 1463 - DNA, 255 bp, Homo sapiens
gggcggggcgtgtgcggactgagcgctctgcttccggggcgcgggtgacgcgacgacggcgacactttgctacggagtgcatcggacgtcgaagcctagagtctctgcgtctttccctcttccgctgcctcattcctttccttcctagccttggtcgtcgccgccaccatgaacaagaagaagaaaccgttcctagggatgcccgcgcccctcggctacgtgccggggctgggccggggcgccactggcttcacc

SEQ ID NO: 1464 - DNA, 255 bp, Homo sapiens
aagttcctctttggagaggcaagagggcaaagaagctgaggacccagaagacaggattgtgcctaagaaagtggccttggagcagaggcccaaagaaagcggggagagcgccttgcccatcggtaagggaaaggtgctccaggcacagaagcagctaatgcaacggccctgaggcaaatgcaagataactggcaagttccaggaacagcaaggagggcaaggcgcctggagcagaggaagctagcggatcccttg

SEQ ID NO: 1465 - DNA, 255 bp, Homo sapiens
atttcagaacaacgggataggatgatgacatcacaaggggatggggactcttgtcgtctcagagagaacgtgccagcctggctctgctttcttttcctagagggtctaacacctctcccggccctgacatctagctggttcctgaggaggaggcagaagtcatgaggaggcaatggggaaacagccatggcagccagtgcctgcctgtggatgcttggacattaaagggtcaccagctgagtgtgggctgagtgt

SEQ ID NO: 1466 - DNA, 255 bp, Homo sapiens
agagcagggcctgacatctccccagaacagacgtttgaacagagcaggcttctgaggtctccaaaatgcctgtcccagcctcctggccccatcctcctggtcctttcctgcttctgactctactgctgggacttacagaagtggcaggtgaggaggagctacagatgattcagcctgagaagctcctgttggtcacagttggaaagacagccactctgcactgcactgtgacctccctgcttcccgtgggacccg

SEQ ID NO: 1467 - DNA, 255 bp, Homo sapiens
ggccgccgggcgcagtcagccgccgccacctccgccgcgctctgtccggacggacgctcgccgcccgcagcctgccgcccgccgcagggcgctgacggtcccgcacgtctgccgctgccaccggcgcgcccgaaacttccagcactatgttgaataagagtggtgagagcagatatcctgccttgttcccggtcttagggggttcatccatgagctcggatttcccacattacaacttcaggatgcctaatattg

SEQ ID NO: 1468 - DNA, 255 bp, Homo sapiens
ggggaggaagaaaggcgaaggcaaggcgaaggggtggagagtgatatgaagagcgagagaaaagagaggacagcggacgagcagatccggtatctggaatcccggcgcctagaacgtgtttttcgggagagcaaaggctgtgtctacggcagcctggggatatagcctctccttccgatgaaaagagaaaggaagaatggactacagccaccaaacgtccctagtcccatgtggacaagataaatacatttccaa

SEQ ID NO: 1469 - DNA, 255 bp, Homo sapiens
ggaggcgggagggggcgtggcctcgacgggcaagcggcgataagaggtggcgtcctccgcggcattgcgagcaccgccagtctgcgccgctaggcgtaggcggggtggcccttgcgtctcccgcttccttgaaaaacccggcgggcgagcgaggctgcgggccggccgctgcccttccccacactccccgccgagaagcctcgctcggcgcccaacatggcgggtgggcgctgcggcccgcagctaacggcgctc

SEQ ID NO: 1470 - DNA, 255 bp, Homo sapiens
ctgcccggcgtgctgggtagaggtggccagccccggccgctgctgccagacgggctctccgggtccttctccgagagccgggcgggcacgcgtcattgtgttacctgcggccggcccgcgagctaggctggtttttttttttctcccctccctcccccctttttccatgcagctgatctaaaagggaataaaaggctgcgcataatcataataataaaagaaggggagcgcgagagaaggaaagaaagccgggag

SEQ ID NO: 1471 - DNA, 255 bp, Homo sapiens
gcggcggcggcggcggcggcagcagcggggctgggggcggcgagtggcccgcgcgacacgcgccggcctcgaccctatgctttgattcgcgtggcgcaggcgcctactgccccgccggcggggcccgggcttcctgccgcgggatgttctcccgaaggagccacggggatgtgaagaagtccacccagaaggtgctggacccgaagaaggacgtgctgacccgcctgaagcacctgcgggcgctgctggataatg

SEQ ID NO: 1472 - DNA, 255 bp, Homo sapiens
gcgcaacgtcatttccgcgtacgggggagggcgggcctggagtctgagccggcgccgctcagtgtgaggtggtttctgcgggtgaggctggcgcccgtaccatgagcgaggcggacgggctgcgacagcgccggcccctgcggccgcaggtcgtcacagacgatgatggccaggccccggaggctaaggacggcagctcctttagcggcagagttttccgagtgaccttcttgatgctggctgtttctctcaccg

SEQ ID NO: 1473 - DNA, 255 bp, Homo sapiens
cgcgccgcagccccgcgcgtccggccgccgcccgcgcccatccagcagcctcgccggagccacaccgcgggacagacgcggccgcggcgcgtcccggcccggtccagcccagcccagcccagtcccggcaccgggcggcccggcggccggcccgcccccgagggcgccgggcgcggcgggaggatgccgaagccgacgctgctgctgcgcgggggctgggagcgcgagcgcagccccggggactcggagctgggc

SEQ ID NO: 1474 - DNA, 255 bp, Homo sapiens
cttccgttagcatgacccggcctgaagtagcggcggaacggaagtcgcttgtgtatgaacgcagcggcggacctgtgaggggatccgacttgccggcagaacttacgctgcgggaccccgggcactgttgctgctgcgggagtccagagaggcaggaggatggagctcggaaggatttcagctccaggctggctgctggaccgacttttcaacattttttaaaaagtgcctcagctcctcaggagaagctgtctt

SEQ ID NO: 1475 - DNA, 255 bp, Homo sapiens
atgaatatgcaagtgcgaggaagatatttaaaggcgtcggcgccacgcgcatatccctgctcggcgctgcccgcccagttcctgttcccagactgaggcccagcccccttcgcccgtttccatcacgagtgccgccagcatgtctgacaaactgccctacaaagtcgccgacatcggcctggctgcctggggacgcaaggccctggacattgctgagaacgagatgccgggcctgatgcgtatgcgggagcggta

SEQ ID NO: 1476 - DNA, 255 bp, Homo sapiens
ccacttccggcaggcgctgcgctgctggggggcgcgggcgaggatggcggcggagaacgaggccagccaggagagcgccctgggcgcctactcgccagtggactacatgagcatcaccagcttcccgcggctgcccgaggacgagccggcgcccgcggccccgctgaggggccgcaaggacgaggacgcctttctgggagaccccgacaccgacccggactccttcctgaagtctgcacggctgcagcggctgcc

SEQ ID NO: 1477 - DNA, 255 bp, Homo sapiens
gcagtggcgcggattcccggaagaacccgcagcagctcccaggatgaactggttgcagtggctgctgctgctgcgggggcgctgagaggacacgagctctatgcctttccggctgctcatcccgctcggcctcctgtgcgcgctgctgcctcagcaccatggtgcgccaggtcccgacggctccgcgccagatcccgcccactacaggtgaactgtgacccgccctttcgcagttggggaatgggaagcgtgaac

SEQ ID NO: 1478 - DNA, 255 bp, Homo sapiens
atttggagcttggggcagcttctcgcgagagcccgtgctgagggctctgtgaggccccgtgtgtttgtgtgtgtgtatgtgtgctggtgaatgtgagtacagggaagcagcggccgccatttcagggagcttgtcgacgctgtcgcaggggtggatcctgagctgccgaagccgccgtcctgctctcccgcgtgggcttctctaattccattgttttttttagattctctcgggcctagccgtccttggaacccg

SEQ ID NO: 1479 - DNA, 255 bp, Homo sapiens
aggatgggtcctcggccggctcgactagaagactaagggggcgtctccccggcttcctgcggcgtcggtggcgagctgaggtggaggcaggctgcggcagacggcgacagtggcggcggcgccatggcagggcttgcaggggcgcgagttgggaaccctctcccacccgaaaccccgtcagacttacctgcagcagcacgcggaagatgtaccagccgatgatgagcagttcagccgaggccgccgccactgccg

SEQ ID NO: 1480 - DNA, 255 bp, Homo sapiens
gcgagaggccgggcaggccgggcagggagtgcgggtcggttctgcgtgcgctgccggacgaggctcccgccgccgattgacccgcgctccgcccgtagtcgggccgggaccttggtagctaatgtccgaagaaagtgactctctgagaaccagcccttctgtggcctcactctctgaaaatgagctgccaccaccacctgagcctccgggctatgtgtgctcactgacagaagacctggtcaccaaagcccggga

SEQ ID NO: 1481 - DNA, 255 bp, Homo sapiens
cgcagcggaggaaagaggatggcgacctcgtcgatgccggagtcagagaggaacgtggctacgaaagcctcggagtgaagttcccagaccctacgccccgctgtcaggcagcccgccgatcagatggaggagaacgaggtggagagcagcagcgacgcggcccctgggcctggccggcccgaggagccctctgagagcggcctgggtgtgggcacctcagaagccgtgtccgccgacagcagcgacgccgcggcc

SEQ ID NO: 1482 - DNA, 255 bp, Homo sapiens
tcccaagaaggcggggcgggcggaggctggaggagccgccgagcggagacccgggagcaggagctgggcctaggtctgcgccctggagggaggtgtagaaagaggtacatggagaacaagtttgtcaatccgtctgaacttcagttgccttacctgtaaggcagccgtgtctgtgtttttgtctcgcagaattagagcccattgggaacgatgccaccaccgtcagacattgtcaaagtggccattgagtggcca

SEQ ID NO: 1483 - DNA, 255 bp, Homo sapiens
cgcttcatgtggcccggcccgcgacggccggcggctgggagcggcgaggcggcggcggcggcgagtggcggcccgcgaggcccgggaggcggtggccgaggcccaggcggtggcggcggcggcccaggaggcggcggacggggagctgcgggagcaggcccggcctggctctctagcggccgcctggctgcagcatgcgcgcccgccgggggctgctgcggctgccgcgccgctcgctgctcgccgcgctcttct

SEQ ID NO: 1484 - DNA, 255 bp, Homo sapiens
atggcctccttggaagtcagtcgtagtcctcgcaggtctcggcgggagctggaagtgcgcagtccacgacagaacaaatattcggtgcttttacctacctacaacgagcgcgagaacctgccgctcatcgtgtggctgctggtgaaaagcttctccgagagtggaatcaactatgaaattataatcatagatgatggaagcccagatggaacaagggatgttgctgaacagttggagaagatctatgggtcagac

SEQ ID NO: 1485 - DNA, 255 bp, Homo sapiens
ggcaggggcgcatccctcgccacccgcggtcgcccagcacgccgggacgcgcgtggccatccagctccccgggggcgttggggggctccgcgggcctgggcctcgggattcgcccgccgcttccccggggagccgctgctgcaaagccaggttggggcgccgggcccggccagcgccctctaggcagcggaagtgcagcttgctttacatccgtcctccccgcctcgcagagttgggagaaggcagggtgggggg

SEQ ID NO: 1486 - DNA, 255 bp, Homo sapiens
gacaaagagaactaatgctttgtgctgattcatatttgaatcgaggcattgggaaccctgtatgccttgtttgtggaaagaaccagtgacaccatcactgagcttcctaaaagttcgaagaagttagaggactatacactttcttttgaacttttataataaatatttgctctggtttttggaacccagggctgttagaggggtgagtgacaagtcttacaagtggccttattccaactccagaaattgcccaac

SEQ ID NO: 1487 - DNA, 255 bp, Homo sapiens
aaagtgcggggtcggccgggtgctgggccgaggccgaggccggggcgggatccagagcgggagccggcgcgggatctgggactcggagcgggatccggagcgggacccaggagccggcgcggggccatggcgaggcgcgggccagggtggcggccgcttctgctgctcgtgctgctggcgggcgcggcgcagggcggcctctacttccgccggggacagacctgctaccggcctctgcggggggacgggctggct

SEQ ID NO: 1488 - DNA, 255 bp, Homo sapiens
atacacaatcatcatcttactagttctctgtgttgctcgctaaccagtcccccagttcagtagactggagcccagagcctgcttacttgtcaggtgtttattttgtcttgctttttttttttttttaaatgaagtcaaaatgccaataagaccagatctccagcagttggaaaaatgcattgatgatgctttaagaaaaaatgatttcaaacctttgaaaacacttttgcaaattgatatttgtgaagatgtgaa

SEQ ID NO: 1489 - DNA, 255 bp, Homo sapiens
gtcgccgcctgacgccgcccgtcgccggcagcgcaggacacggcgccgagggtggggcgcgggcgtagtggcgccgggagtcgcgggtgcgcgcgggccgtgagtgtgcgcttttgagagtcgcggcggaaggagcccggccgccgcccgccggcatgagctacgaccgcgccatcaccgtcttctcgcccgacggccacctcttccaagtggagtacgcgcaggaggccgtcaagaagggctcgaccgcggttg

SEQ ID NO: 1490 - DNA, 255 bp, Homo sapiens
ctcgtcctccgcccgccgcgcgggggcgccgctctagccccgcgccatctcggtggccgtccgcccactccgcggcgttcggggaaatggctgcgagaccctagaggcctgcggagcttactccacgggaacagcctctagataatctgagttgttgaaaatacgaagcctgttactcgtgaacagtggctgacaacagtgttgttgtgagcctggctgtctgcttggacccagaggtttcgtctgccagggttt

SEQ ID NO: 1491 - DNA, 255 bp, Homo sapiens
gcgtgcacgctgacgccgcgcagtctcgtcccctgccgccgccgtcgccgctgctgtcgccgccgccgccgccattggagtcgacgcctcctcagtgcgtccgcgtcccgggctcaccgccgctgccgcctcgccaggggcccgcgcgcccagcagccgccgccgccgcccggccggcgcccggggaattggcggcggggcccggggccgcgcgagctagggtgacaggcccggcctctaggggaggcccgagcc

SEQ ID NO: 1492 - DNA, 255 bp, Homo sapiens
gctgctgctgtgatccaggaccagggcgcaccggctcagcctctcacttgtcagaggccggggaagagaagcaaagcgcaacggtgtggtccaagccggggcttctgcttcgcctctaggacatacacgggaccccctaacttcagtcccccaaacgcgcaccctcgaagtcttgaactccagccccgcacatccacgcgcggcacaggcgcggcaggcggcaggtcccggccgaaggcgatgcgcgcagggggt

SEQ ID NO: 1493 - DNA, 255 bp, Homo sapiens
gtctactcagcccggtggctgtcgcgcgtggaatcgcgtaagaaaagccgagtttgtggctggggagagaaggccaccgtgctgagctggatttagcgaagactggttttggggaccggagagcccaggactccctttgttggagttttgcccacgcgttgtaattaagcctcgcacaatatggttgatgataattagaagcatgctttccactgaacttcccgacaacatttgttatgcagaatgtctctgagt

SEQ ID NO: 1494 - DNA, 255 bp, Homo sapiens
aaaaggaaattttctgggaaatggttcatattttgtggtggtgacattacaggaggtgtcctagccttctgaggctgtagcctatctgactagtctcatggatcaaatctattgtgatttttatcccccttaaggaaaatatttagtgatttgagaaggaatataaataggtcagtgtctccttctgttacagttgcctgctttcaatcctaacaaggactgatcctgcctgggagaaacaaaaataatcttggg

SEQ ID NO: 1495 - DNA, 255 bp, Homo sapiens
cccgcccatctccgctggttcccggaagccgccgcggacaagctctcccgggcgcgggcgggggtcgtgtgcttggaggaagccgcggaacccccagcgtccgtccatggcgtggagccttgggagctggctgggtggctgcctgctggtgtcagcattgggaatggtaccacctcccgaaaatgtcagaatgaattctgttaatttcaagaacattctacagtgggagtcacctgcttttgccaaagggaacct

SEQ ID NO: 1496 - DNA, 255 bp, Homo sapiens
aggcggcgcgtgcgtagaggggcggtgagagctaagaggggcagcgcgtgtgcagaggggcggtgtgacttaggacggggcgatggcggctgagaggagctgcgcgtgcgcgaacatgtaactggtgggatctgcggcggctcccagatgatggtcgtcctcctgggcgcgacgaccctagtgctcgtcgccgtggcgccatgggtgttgtccgcagccgcaggtggaaaaaatctaaaatctcctcaaaaagta

SEQ ID NO: 1497 - DNA, 255 bp, Homo sapiens
gcggtgcacacggcgcctcgccccgcctcaccggcgctctatcctcgcgtctgctcccagctccgggctcccggggctgaggtggagccgcgggacgccggcagggttgtggcgcagcagtctccttcctgcgcgcgcgcctgaagtcggcgtgggcgtttgaggaagctgggatacagcatttaatgaaaaatttatgcttaagaagtaaaaatggcaggcttcctagataattttcgttggccagaatgtgaa

SEQ ID NO: 1498 - DNA, 255 bp, Homo sapiens
atgctgggagcctggaggactagcgaggaggagttgagagaacggagcggacgccatggcgaccaacatcgagcagatttttaggtctttcgtggtcagtaaattccgggaaattcaacaggagctttccagtggaaggaatgaaggccagctgaatggtgaaacaaatacacccattgaaggaaaccaggcgggtgatgcagctgcctctgccaggagtctaccaaatgaagaaatagtgcagaagatagagga

SEQ ID NO: 1499 - DNA, 255 bp, Homo sapiens
agggctccacagtcgttccgccacctcccagtcgggttgcggcggaggccgttcctggctttgtagctcgctcaagatggcggcgcagccaccccgcgggatacgcctcagcgcgctttgcccgaagtttttacatacaaattctactagtcacacctggccattcagtgcagttgctgaattaatagataatgcttatgatcctgatgtgaacgctaaacaaatatggattgacaaaacagtgataaatgacca

SEQ ID NO: 1500 - DNA, 255 bp, Homo sapiens
gggagcgcggcgcgggagcccgaggctgagactcaccggaggaagcggcgcgagcgccccgccatcgtcccggctgaagtgcagtggcacgatcataggtggtcactacagtctcagattcctgggcttaagcagtcttcccacctcagcctccccagtagctgggattacagtgttatagttttgccgctggactcttccctcccttcccccaccccatcaggatgatatgagacttgaaagaagacgatgcat

SEQ ID NO: 1501 - DNA, 255 bp, Homo sapiens
attaactggcattctttaaaaaggcatcagttttcttttgcacaggtgtttggagagcccggactggatgcccactagaatcctgtgctgtgaacagtgagagagttttcttcattttgaggaaccctaaacacctatctttcccaaggcaacctgtctggactgagcatttctctgacttgacataacttcccatccagccaggagtctgcactcttcagtctttgcaggcagtagcagaatcccatggtagcc

SEQ ID NO: 1502 - DNA, 255 bp, Homo sapiens
agaatgatcattagtcctaagcccattcagaggttcaagaatggggtcggctcaatttcagggccttattacccaagcccggctgcccttcggtgccaccagcaccactgctccgtcgctgcggaattccaaaggcaggtttggcgttagggccttggccccagagaggacgccgagcgctccacggaaagtctccgcccggctcccagggcgcacactcgcgcgcacgtggggccgaggccctgctcccggggc

SEQ ID NO: 1503 - DNA, 255 bp, Homo sapiens
cgccgccttctgtgcagtcgcggcccgggcggacggtggctggctgctccgcagcgctcggctggctgcagcggcaccgcgggttgcgcggccggggatgctccagcgggcgcgatggcccccgccatgcagccggccgagatccaatttgcccagcggctggcgtccagcgagaagggcatccgggaccgagcggtgaagaagctgcgccagtacatcagcgtgaagacgcagagggagacaggaggtttcagt

SEQ ID NO: 1504 - DNA, 255 bp, Homo sapiens
gcggggacggcgacgcggcgcaggcggcgggagtgcgagctgggcccgtgtttcggccgccgccatggccgcggtggacctggagaagctgcgggcgtcgggcgcgggcaaggccatcggcgtcctgaccagcggcggcgacgcgcaaggtcccctgacaagcccaccaggccccctgctgagatggctgtgaccctgggctgacccgcccagtggcacattgactccgcctggagctggggagaccagagaggc

SEQ ID NO: 1505 - DNA, 255 bp, Homo sapiens
caaccaccccatgtgtctctagaaccccagtgtagcgagctggagagaggactgtcctgagggcagcaggcctggttgcagctggcgtgggggtctcagaatggagccctcagccctgaggaaagctggctcggagcaggaggagggctttgaggggctgcccagaagggtcactgacctggggatggtctccaatctccggcgcagcaacagcagcctcttcaagagctggaggctacagtgccccttcggcaa

SEQ ID NO: 1506 - DNA, 255 bp, Homo sapiens
ctgaggcgctgaggcggccgtggcggcggcggcggcggcggcggcagcggcggccaagcggccaggttggcggccggggctccgggccgcgcgaggccacggccacgccgcgccgctgcgcacaaccaacgaggcagagcgccgcccggcgcgagactgcggccgaagcgtggggcgcgcgtgcggaggaccaggcgcggcgcggctgcggctgagagtggagcctttcaggctggcatggagagcttaaggggc

SEQ ID NO: 1507 - DNA, 255 bp, Homo sapiens
ggaagctcagcagtgtccactgtcgccattccttggccatagaaaacaatgtatttgaattttgatgtaagcataacaaattgaagatgaagatgacacgttgatttcttgtttgaaattaaccaagtcccgagaaaagaaagtgaatagtgttagcacgaggaggaaggaagaaatggagattagattggatactctttctgcatcactgggtagatccagcactttaaataactgcaacttggaagataaatt

SEQ ID NO: 1508 - DNA, 255 bp, Homo sapiens
gcacgcgcatggaacgcagcgaaggactatggcaggggagaacttcgctacgccgttccacgggcacgtgggccgcggcgccttcagcgacgtgtacgagcccgcggaggacacgtttctgcttttgaacgcgctggaggcagcggctgccgaactggcaggagtggaaatatgcctggaagtagggtcagggtctggtgtagtatctgcattcctagcctctatgataggccctcaggctttgtacatgtgcac

SEQ ID NO: 1509 - DNA, 255 bp, Homo sapiens
atgcggaagagatgggcctgctggagcggaagtgacgctcccggcggctgtggcggcggctgcgggagaaggaggaggaggagccggaggaagagggctgcctccgaagaaaggagaatggcgttcagtaaaggattccggatctatcacaaattggatcccccacctttcagcctcatagtggaaactaggcataaggaagaatgtctcatgttcgagtctggggctgtcgctgtgctctcatctgcagaaaaa

SEQ ID NO: 1510 - DNA, 255 bp, Homo sapiens; identical to SEQ ID NO: 1497

SEQ ID NO: 1511 - DNA, 255 bp, Homo sapiens
ctcttctcccctgggttcagctgggggccttacggaactccagggtgctggaggccccgttggtctccatttgcaggtgtctcgctcagcgcagctgcccagagccctgtgtcctgagtgatttccagtagattagcagctctgggtctaagcttttaagaaaaaaaaaaaattgcactacccttcagtaggggcagcattcacatctcacacccaggcagaagcagaaacggccaggaatccaccccactttct

SEQ ID NO: 1512 - DNA, 255 bp, Homo sapiens
cgctgccccgtccacgccgcccgcgccccgcagtcccacccgcaggacccccggccgcgccagggtctcgcctgcgccccccgcgcccgcccgcggactacaagtcccgccatgccccgccgccgccccccggcttccggtgctgcgcagtttccggagcggatcgcaacccggagtccggatccgatcccgctctgcacattccaaaggcaggtgtcagagatggctgaagatgggagcgaagagatcatgttc

SEQ ID NO: 1513 - DNA, 255 bp, Homo sapiens
gctcgcgcccctgttccgcaggtgtgcggggcttgcgcccagcccgggccgcggccgccgcgcgtttcctccccgcttgcccgcccagaggcccccggccacgctcctcgccgggctccgaccccgccgcgccccctccacgcccccagcgcgctgtggccgcagccagcgcgtgtcctgagtccgccgttccggcccggggctgccggggaagttggggcgaggcgggccggggatgcgccatggccatggccc

SEQ ID NO: 1514 - DNA, 255 bp, Homo sapiens
cggcgtctgcgcctggcgtcaccgaccggtgcggacaggaagaggctctgggctggcacatgtgtatggcggtgaggcgggcgggtacatggcgggctctgtgggactggcgttgtgcgggcagacgttggtggtgcggggcggcagccgattcctggccacctccatagcaagcagtgatgatgacagcctcttcatctatgactgcagtgctgcagaaaagaagtcacaagaaaataaaggggaggacgcgcc

SEQ ID NO: 1515 - DNA, 255 bp, Homo sapiens
gtccgggtgacgtctcccgagggcgtcggcagggtcggcggcgtcggcagcagtgtcgacggcagcggcggcggcgggtgggaaatggcggagtatctggcctccatcttcggcaccgagaaagacaaagtcaactgttcattttatttcaaaattggagcatgtcgtcatggagacaggtgctctcggttgcacaataaaccgacgtttagccagaccatcttgattcaaaacatctatcgtaatccccaaaac

SEQ ID NO: 1516 - DNA, 255 bp, Homo sapiens
cttggttccgcccgcgcgtcacgtgaccccagcgcctacttgggctgaggagccgccgcgtcccctcgccgagtcccctcgccagattccctccgtcgccgccaagatgatgtgcggggcgccctccgccacgcagccggccaccgccgagacccagcacatcgccgaccaggtgaggtcccagcttgaagagaaagaaaacaagaagttccctgtgtttaaggccgtgtcattcaagagccaggtggtcgcggg

SEQ ID NO: 1517 - DNA, 255 bp, Homo sapiens
acggtggcccggaagcagtccccggtgtcggggcaggaggcacgcgcgcggctgaggcgaggtcgctcggcgcagctgttgcggggccatggcggggaccgcgctcaagaggctgatggccgagtacaaacccttgagaacgtgcagtgagagcttgaggaagaaggcctgacttgctgctgcggaattaggagggaaaagtgtatgcgttaaaaggggaaaggctcgttggtggagctttgaaagaattaacac

SEQ ID NO: 1518 - DNA, 255 bp, Homo sapiens
atccgcgccgcgcaggcgcactgagcctcagccgctctcctcgctaccaggctcctttcctctatcgcgcaggcgcactgaacctcagccgcgccgggaggcgagcccgttggcgaggggcggggcagatggcgagggagcggggcgagctgctttttgaggctgcgcactcgcatggccccacctcgcaggtccacttccggcgccgcggctgttccgggcggagaccgcttgtgctggagtcggagttgtaac

SEQ ID NO: 1519 - DNA, 255 bp, Homo sapiens
cggaagtgcgtggccgcccggggccatggcgacactcagcttcgtcttcctgctgctgggggcagtgtcctggcctccggcttctgcctccggccaggagttctggcccggacaatcggcggccgatattctgtcgggggcggcttcccgcagacggtatcttctgtatgacgtcaaccccccggaaggcttcaacctgcgcagggatgtctatatccgaatcgcctctctcctgaagactctgctgaagacgga

SEQ ID NO: 1520 - DNA, 255 bp, Homo sapiens
taatacttaattaccttctaataattggagcagaagatgaacccaactaatcctttcagtgggcagcagcctagtgctttttcggcgtcttctagtaatgtaggaacacttccatctaagccgccatttcgatttggtcaaccttctctttttggacaaaacagtaccttatctgggaagagctcgggattttcacaggtatccagctttccagcgtcttctggagtaagtcattcctcttcagtgcaaacatta

SEQ ID NO: 1521 - DNA, 255 bp, Homo sapiens
ctgggcccgggctggaagccggaagcgagcaaagtggagccgactcgaactccaccgcggaaaagaaagcctcagaacgttcgttcgctgcgtccccagccggggccgagccctccgcgacgccagccgggccatgggggccgcacgcagcccgccgtccgctgtcccggggcccctgctggggctgctcctgctgctcctgggcgtgctggccccgggtggcgcctccctgcgactcctggaccaccgggcgct

SEQ ID NO: 1522 - DNA, 2159 bp, Homo sapiens
agttacccctttgcaacagaacgaggccggcattttctaaagcgtccttgaggagtccagttcctaaaagattatttcagagtccactgttgtgggctgacttgaatgctctcaaaattcgtaagttgaagccctgacccccaggacctcagaacgtgactgtgcttggacacagggactttccagaggtgattaaggtgaagtgaggtcactggatggccctcctcctatctgactggtgtcctgatggggacgcggacacccacacaggaacggacccggggagaacaacacatcgtctctgcgccagggagagaggcgtccggggaacccagccgtgcccacgcatttatctccgccttccggctcagaattgtgaggaaacccgcttctgttgtgcaagtcccgggtctgtggtgctcggccatggcgcccccagaactgcatccccaccttctgctctgagccacccatcccctctggaagggctgagcttctctccctttccaccttctgttctgagccacccgtcccctccagaagggctgagcttctctctctttcactgcctatgctctgggaaactttcagaatccccaggctgtttctggaatagtctgggatggtcattttcggtcctcacagaaccgggggtttggaaagtaggtgaagccatatgggttgcagagaatctggcccagcccctcactagtccctgtgcttgttagttattctttaattacttggatatcaactctgatttaaaacatcaatttaacatacagataatgctgggactgcagcttcgccaggtggccttcctctcccggtctcgggaggcgtcacccccatcttgtccccccaagatcaagcgaaaagggcaaagttatctttttttttgcaaaattcaaacctttccctccttcccaggtctgggtcgcttgcgaccctcctctcaggctgcttctgacaggcccaagtcacagccaacttcaggggagctgtgttggatccctccaaactccgggaatgatgtgacctccccggcgctcaccctgggcctctaggttagactcagcccagaccctggctcacagggaagcagagcccatggctggcctccacccgctcagacgcccgcacacaggccaggggagggcttgggggcagctctgggagggtccctgtttgcgctgtgggtgtccaaggctgggtgtgcagagctgaggttgccacacacctgagggactctcgcataaggatggcgcggggctggaagctggactgagacagtgaatgagacagcgctgccggctctctccgcgccgtggactggctcctaggcagtctcacgagcaagtgtggtgttgctcgtgcacgtgtgttttaactgagatgtgagctggcgcgttttctccacccggctccatctgctgggtccctccacattgctgcgcgtgtgcctccagtgccatggggtccccactgtgggcagccccgcattttgcccaactgcctcccaaaccatggaaccccagtgacctccaacttgccgccatgacgagccactctcattcatatcctcaaacacggtgctctgagcccgaatgagggtttctttagagagatatctggggaccaaactgtagggacagagctcccgtctaaggtgggcctgtggtgaggtctccccagtggtacactttaatcccacagcagggcttgcaggccgccctgctccatccccaccaacactgggcaggatctagcctccaaacctttgccagtctaatagtataaaatgatagctcggtgctattttggttttgcatttccatggtgaacaatgagtttgagagtttttgttcaaaagtcctttgggagttcgagaccagactgggccaccaggagttcaagaccagcccgggcaattcagtgagatgttcatctctacaaaaaataagaaagataaaaaattagccaggcatgtttgtgtgtgcctgtggtcccagctcctcaggaggctgaggtgggaggatggcttgaccccgggaggtggaggctgcagtgagttgtgatcgtgtcagtgcacggctagcctgggcaacagagtgagaccccgtttctaaaataaaaataaaaaacaaaagagaaaagtc

SEQ ID NO: 1523 - DNA, 255 bp, Homo sapiens
accgtcagcgcagggctcgccgggaaatgtggtttctccagccggcccggggcggtggccgcaagttgggcttacagcgcggccgatccggcgtggacccgggatggctggaccgggcagcacgggggggcagatcggggctgcggccctggcaggcggcgcgcggtccaaggtagccccgagcgtggacttcgaccatagctgctcggacagtgtcgagtacctgacgctcaacttcgggcccttcgaaacagt

SEQ ID NO: 1524 - DNA, 255 bp, Homo sapiens
gtttccggggcgcgccgcggaacccggaagtggtcacggaactcggctgcggctccatggtctgagttgtcagccgttgttttttcgtgctcgctagtcgccgccgccgctccgccatggggaagcgacagcaccaaaaggacaaaatgtacattacctgtgctgaatacactcacttttatggtggcaagaagccagatctcccacaaacaaattttcgtcgtttaccttttgaccactgcagtctctctctgc

SEQ ID NO: 1525 - DNA, 255 bp, Homo sapiens
tggccaagggcggggcccgcgagggaggccgggcggcccggcaagcggcgctgcggggtaggctgctttcctgaggccggactcaacgggtctcggctgagccaccgggtgagctcaccgcccagcccaaaccaggagattgcgagggagcgatgcggtgcagcgcgtgttcttggggaagatcccgactaagccattttccagtggcacctcttccatcatgagttcctgaggcagtccgatggggctacttta

SEQ ID NO: 1526 - DNA, 255 bp, Homo sapiens
gggaagtcctggcccttggcccaacctcctgctgtccccggtctgagggcccaagccccgcgtctccgccttgccgtccagcctgtccttggtgtggggtgcttggaagtgtgagcaccctctctggctctttgccggccccaagggtcgttgcggcggcccccgggcccagtcatcagccctcttttccggtgccggaactatcgtactggtgccctagtttcccagccggcaggcggagtgaggaggaagcgg

SEQ ID NO: 1527 - DNA, 255 bp, Homo sapiens
tgcgcttcccgcgggcgcgcggagtgaggacggtgacagccacgcgcgcgcgtacgcgcccgatgcagcgcggccccgtgaccctagtcggccgctgagaggcgcgcggagtctgggccgctgccgtctaggggtcccgtcccgaggcgtccccggcatctccggcccgaatcccggagtgccgggtcgcgcctgcaccgaaggtcccggctcctgtgccctccctgcagccgtcagggcccgtcccccaactcc

SEQ ID NO: 1528 - DNA, 255 bp, Homo sapiens
tgacagcagcgcttctttcttagctagtcaccggcccctgctcaagaatgccagtgtgtgtgtagcctccacagagaggtcgttttctcggagtccagaggggccgcctgagcttctgagaactagggaggagccatcccagccatgagcccctgtgggaatctgctgggggccaagtggcctggagtcctcaggctcccgcagctgctccggagggagaggtgagctcagggcagcctgcctgcagccagaggt

SEQ ID NO: 1529 - DNA, 255 bp, Homo sapiens
ccccattcgcaggacagctcttacctgccgggccgccgccccagccaacagctcagccgggtgctccttcctgggctccacgcccggagctgcttcctgacggtgcagccgcaaggcatcgcaggggccccgcgctactgccctgctccctcaaagtcccaggtcccctcccctggtgctgatcattaaccaggaggccgtataaggagctagcggccctggcgagagggaaggacgcaacgctgccaccatgga

SEQ ID NO: 1530 - DNA, 255 bp, Homo sapiens
accgcctcttgtttttcccgcgaaactcggcggctgagcgtggaggttcttgtctcccctggtttgtgaagtgcggaaaaccagaggcgcagtcatgtcgggattcgacgatcctggcattttctacagcgacagcttcgggggcgacgcccaggccgacgaggggcaggcccgcaaatcgcagctgcagaggcgcttcaaggagttcctgcggcagtaccgagtgggcaccgaccgcacgggcttcaccttcaa

SEQ ID NO: 1531 - DNA, 255 bp, Homo sapiens
ggaggaggagcctctgccagactggagagaagcaggcctgagcctccccaaaggcagctcctggggactcccaggaccacaggctgagacgagacgcagggtggctggaggaagtgagaggtgaactcagcctgggactggctgggcgagactctccacctgctccctgggaccatcgcccaccatggctgtggcccagcagctgcgggccgagagtgactttgaacagcttccggatgatgttgccatctcggc

SEQ ID NO: 1532 - DNA, 255 bp, Homo sapiens
agtcggcccctcagaccctggagcgatggaggaccccggccccggcgcggtccagcggtgggagcgggcgccgcccacctgtcggatccctgggccatgacccctgggacggcgagtgagctgcgccgggaacccccgggacggagagagcagcctccaacccccaaggctcacattgcttcacggagtagcggcccggggaaggagcacgcgagcggttccccggggttgcatctcacacccgggagggaggga

SEQ ID NO: 1533 - DNA, 255 bp, Homo sapiens
cgcccacccatccggggcaagagccgcgccgcaggagaggcaggctggaccgggggctccccgggcccgcgacccccgccgtgaccccgcagcccccagctcgcccccaagatgatgaagaggcagctgcaccgcatgcggcagctggcccagacgggcagcttgggacgcaccccggagaccgctgagttcctgggtgaggacctgctgcaggtagaacagcggctggagccggccaagcgggcagcccacaac

SEQ ID NO: 1534 - DNA, 255 bp, Homo sapiens
atttcctctgggttacggcgcaggcgcaagataagctaggagccgcgcgagtcgtagtgtcgctgtttgcgggtctccgcgcgggaccggggcgcagcggggtcgctgaggcgagggtgtcatgtcagacaacgaggacaattttgatggcgacgactttgatgatgtggaggaggatgaagggctagatgacttggagaatgccgaagaggaaggccaggagaatgtcgagatcctcccctctggggagcgacc

SEQ ID NO: 1535 - DNA, 255 bp, Homo sapiens
ggagaaggggtggggcagggtatcgctgactcagcagcttccaggttgctctgatgatatattaaggctcctgaatcctaagagaatgttggtgaagatcttaacaccacgccttgagcaagtcgcaagagcgggaggacacagaccaggaaccgagaagggacaagcacatggaagccagcccagcatccgggcccagacacttgatggatccacacatattcacttccaactttaacaatggcattggaaggc

SEQ ID NO: 1536 - DNA, 255 bp, Homo sapiens
tttttttttttttgagaggaagcctcgctctctcacccaggctggagtgcagtggcaggaacttggctcactgcaacctccgcttcccaggttcaagtgattctcctgcctcagcctccagagtagctgggattacaggcgcacgtcaccacacctggctaatttttgtatttttagtagagacggggtttctccatgttggtcaggctggtctcgaactcctgacctcgtgatccgcccgcctcggcctcccaa

SEQ ID NO: 1537 - DNA, 255 bp, Homo sapiens
tttctactttgcccgcccacagatgtagttttctctgcgcgtgtgcgttttccctcctccccgccctcagggtccacggccaccatggcgtattaggggcagcagtgcctgcggcagcattggcctttgcagcggcggcagcagcaccaggctctgcagcggcaacccccagcggcttaagccatggcgtgagtaccggggcgggtcgtccagctgtgctcctggggccggcgcgggttttggattggtggggtg

SEQ ID NO: 1538 - DNA, 255 bp, Homo sapiens
atggctgagagcgcctccccgccctcctcatctgcagcagccccagccgctgagccaggagtcaccacggagcagcccggaccccggagccccccatcctccccgccaggcctggaggagcctctggatggagctgatcctcatgtcccacacccagacctggcgcctattgccttcttctgcctgcgacagaccaccagcccccggaactggtgcatcaagatggtgtgcaacccgtggtttgaatgtgtcagc

SEQ ID NO: 1539 - DNA, 255 bp, Homo sapiens
cccgaggaggaagagctgcagggagacagtgcctccagcgggtgctgccgcgagcggccagccgaggggctggaaatgaaagtaaagcgctccagagccacatggacggagctgccggggcggcggcgccgggagcaggatgcggccgcccgtaattaaatagcatttactcttattattactaataataataacgtaatcatacctctagtcatagcataccatttatcgggctcggcgcaggcccgcggggag

SEQ ID NO: 1540 - DNA, 255 bp, Homo sapiens
ctttcagttgctttgctgttagcctgttggaccttcgagcctagctgctcgcacaggactcggccacctgcccttcctgcaccgactggccagctcaagaggtttggatatggaccttcttcaattcctggccttcctctttgtcctgcttttgtctgggatgggagccacaggcaccttgaggacctccctggacccaagcctggagatctacaagaagatgtttgaggtgaagcggcgggagcagctgttggc

SEQ ID NO: 1541 - DNA, 255 bp, Homo sapiens
ctctcctgcccattccgcggatgggcaatcccaggcggaactcccttgagggtctcagaatatctgggagacctcgggctcttgatctccgagacaccccgtttcgtagtggagaacagtccagatcggggaagtttattttgcccaaagccggttagaggccccctggccctcgattcccagtgcggggctcagagctcccctgaacagcagctgcagcagccatggccccgccctgggtgcccgccatgggct

SEQ ID NO: 1542 - DNA, 255 bp, Homo sapiens
ccgcgccggtttccagggagctgggcgcatgcgccgcgtaaggggcccggccggcggaaggaggtgctactgccggaagcgccggcgcgcttgcgcagtagctgaacgcgggcgtttctttcctccctttttttcgaattggttttgggggtagattcgagttacaaaatggccgcccggagcgtgttcggcgcggttcccccagctgtctctggctgaaccggcgctctcgcctccctgccgaacacagcgtga

SEQ ID NO: 1543 - DNA, 255 bp, Homo sapiens
gggcgcgcgtaggcacaacttccggaaggaggcggaagagcttctcggctctaggctctggagtcccgggagcagtgaggggccacccggggcacaggaaagggccgctaggggagggccgggtgcactcggggtgtctgggccgcgggtctgagggatgaggaggggccatggccagcgacggggccaggaagcaattctggaagcgcagcaacagcaagctcccgggcagcatccagcacgtgtatggtgccc

SEQ ID NO: 1544 - DNA, 255 bp, Homo sapiens
gcgcggggcggggcttccgggcggggcaggctggcttccggcgggagcggggccgcggatggccgtatacagggcagcgctcggggcttcgctcgcggctgcccgactcttgcccctcggtcgctgttccccgtcgccggcgccccgctctacgttgtcgggcgccgccatggagcccgcgcctcgctggctggcggggctgcgcttcgacaaccgcgccctgcgcgccctgcccgtggaggcgccgccgcccgg

SEQ ID NO: 1545 - DNA, 255 bp, Homo sapiens
gtgcgccgccgccgccattttggagcgatcggagtgccgcccgcggccccgagtcggtctcgagccgccggccggccgtgccggtgtccgtaggcgctgcgccctcggccgggcccatgtgtgtgcggcccgcccgaggccgcccgggctttgcctccaccagcgccctggcctccgctcgggcctccacacgggcctccgaagagctgccgcgacgcccggcccgcagggcaggtaaagagattataaatcttc

SEQ ID NO: 1546 - DNA, 255 bp, Homo sapiens
gcgcctacgcattttcctgggcgggaacagcaaaatggcgccagaactagtggcgggctgaggacgccgtacccctcggaaggcagccctgcggtccctttgccgcccgttccctcccggacatggaggacgtggaggcgcgcttcgcccacctcttgcagcccatccgcgacctcaccaagaactgggaggtggacgtggcggcccagctgggcgagtatctggaggagctggatcagatctgcatttcttttg

SEQ ID NO: 1547 - DNA, 255 bp, Homo sapiens
gaggggccgaggccagccccggagaggagaaaacccgcgggcctggccgggtgcaggccacccttgccggcggatcggaatccccgcccacaccgtggtctttccagcaccgcagacacctgccggctcctcccgagcggagctcagggctgacaaagcgcggtcagagcggccgcttactggggctcgcccgctccttagagcactggcaatgatgtgcggatcctcgctgctgctgctgggaaactgttgagt

SEQ ID NO: 1548 - DNA, 255 bp, Homo sapiens
ctggctcggaccacgcggggcgggacctggagctgacgcggccgccccgcccctgggaccataaccggccgccgccgccaccgcggaccgagcgcggagttctggagtctcggacccgaagccgccacagggcgccccgcctcccgcccgccatgcccgcgccccgcgccccgcgcgctctggcggccgccgcgcccgcgtccgggaaggccaagctgacgcacccggggaaggcgatcctggcaggcggcctgg

SEQ ID NO: 1549 - DNA, 255 bp, Homo sapiens
acgtgacggcccaggcccccgccccgccggctcctctcgcccagcctcccgcctcgcgcctcccgcctcccgcctcccgcctccctccagctgcgagtgcggcctcggctggcggcggcaccaggccacagttgtaagggatcttgtggctgtcaggatggcagaggagcaggagttcacccagctctgcaagttgcctgcacagccctcacacccacactgcgtgaacaacacctaccgcagcgcacagcactc

SEQ ID NO: 1550 - DNA, 255 bp, Homo sapiens
cggatgcacctacgcctgcgccctgaggtcgggcgctcgcgggccaggagcggggagccggcgggcagcgccgcggctcgtgaggtgatggcggcggccccggcccggggaggcggaggcggaggcggaggcggcggcggctgctccggctccggctccagcgcctcgcggggcttctatttcaacacggtcctgtcactggcccgctccctggcggtgcagagaccagcatccttggagaaggtccaaaagctt

SEQ ID NO: 1551 - DNA, 255 bp, Homo sapiens
gcccctccctccgcccgcccgccggcccgcccgtcagtctggcaggcaggcaggcaatcggtccgagtggctgtcggctcttcagctctcccgctcggcgtcttccttcctcctcccggtcagcgtcggcggctgcaccggcggcggcgcagtccctgcgggaggggcgacaagagctgagcggcggccgccgagcgtcgagctcagcgcggcggaggcggcggcggcccggcagccaacatggcggcggcggcg

SEQ ID NO: 1552 - DNA, 255 bp, Homo sapiens
gccaggcagcgtcggccgcgtcggccgcgggttggagcagctcaggtgcggccccgccccgcccgcctgcggccccgccccggcccaggtgagctgccccgccccggcccaggtgagtggccccgcgtccgccggtgtgacctgagtccgcctgaccacctgtccctccggtggccctgggtgtgcgtgtccccaatcgcggggaagcctgtaggggcgccacgtcgccgcctgggcagcgtgtgcgggtccgtg

SEQ ID NO: 1553 - DNA, 255 bp, Homo sapiens
cttccccggctggggcggctggagagccgggagtcgctgggtgcgtggggctgcctcgccgcgtctcgccacgggctctgccagcagacagccttggcacacaggcacaagggctggagcccagagatgagagtgcccaagggagatgtgagcctggcgggctgcccgctaacctgtcgctgaagccccagaagcgggccctcaggccaggcctaccctgcctccggcccagcatgcgcctgtcggtgcggaggg

SEQ ID NO: 1554 - DNA, 255 bp, Homo sapiens
accttcgcggccgcaactcgctcggccgccgccatcttgcgagctcgtcgtactgaccgagcggggaggctgtcttgaggcggcaccgctcaccgacaccgaggcggactggcagccctgagcgtcgcagtcatgccggccggacccgtgcaggcggtgcccccgccgccgcccgtgcccacggagcccaaacagcccacagaagaagaagcatcttcaaaggaggattctgcaccttctaagccagttgtgggg

SEQ ID NO: 1555 - DNA, 255 bp, Homo sapiens
aaagagcccgggaccagcgcagagggcctgatgcctgatctgtcaagtctgtccgaccgtgcctgtctgctgtccccccagctgttccagtggtggattggcaggaccgggtgcctacccggtactccttaccaaaggagcccctggtagtgcccacctagcccaggacaaggagtggaacgggagctgcagctgcagtggtcacgaaggcagcctggaggaggtggccatggaggatagccttcgttatcgtca

SEQ ID NO: 1556 - DNA, 255 bp, Homo sapiens
agctgaaaaacagctcgcgctgcagcaagctagctgggaagctcccagttctaaagagaggctgtttaccagaacagcataacaagggcaggtctgactgcaaggctgggactgggaggcagagccgccgccaagggggcctcggttaaacactggtcgttcaatcacctgcaagacgaaggaggcaaggatgctgttggcctgggtacaagcattcctcgtcagcaacatgctcctagcagaagcctatggatc

SEQ ID NO: 1557 - DNA, 255 bp, Homo sapiens
gggcctactctgccgccgccgccgcccgcccgctccagccgccgccgccgccgccaccgccctccaggctccgggacccggcccgcgccaccgcccccgtgcgcgccccgccgccgccgccttcgccttcgccttttgtttcctccgctccggcgcccccgccccggctcgcgctttgcaggggacgcagcgcgcgcccccagcgggcccgggaaaagccgcggcgcgcgcgcgcgcctgcgcggcggacccctc

SEQ ID NO: 1558 - DNA, 255 bp, Homo sapiens
atagagacgaagaggtggcggcggccggagcgcccccggcctctgtcggctccgtaggctcaggtagacctggcgacgacggggctgcagctgcaggggctgagctggctgggcaagcgcgggccgcggaggaggtctcaggggtgaatcatttgatgtaaaagacttgactccataatctgcatctgtcctaatgctgtcatctggagtagagactcagccagttccacttgattcctccatgtctgccgtggt

SEQ ID NO: 1559 - DNA, 255 bp, Homo sapiens
gcagccagagctcagcagggccctggagagatggccacggtcccagcaccggggaggactggagagcgcgcgctgccaccgccccatgtctcagccagggcttccttcctcggctccaccctgtggatgtaatggcggcccctgctctgtcctggcgtctgcccctcctcatcctcctcctgcccctggctacctcttgggcatctgcagcggtgaatggcacttcccagttcacatgcttctacaactcgagag

SEQ ID NO: 1560 - DNA, 255 bp, Homo sapiens
gcgggcgggcgggcaggaggccgggaggagggaggcggcggcggcggcggcggcggcggcgagagcccagagccagagcccggccggggccgagcggagcgcggcggcggcggcggcggcggcggctgggccgggagaggctggcgcgccgggcggctccgcgaatcctccggcatccgccccggcgggccgcccccgcccgcggcagccccccgagcagtggcccggcatcggcgccttcccggcgggcaagag

SEQ ID NO: 1561 - DNA, 255 bp, Homo sapiens
cgcacacatacagagtcggccacacgcgcgccgcccggccccactcgcgcagcgcgggcctccgccggccgcattgtccgcccgcccgccttgtcccgcgtcgccgctcttcgcgtgcccgcgcgccccgggcccggccgctgtgtcgccctgagcggagcgccgcccgcgggatccccacgcggaaagggggcgcgccccggcggcggcctggcctcggacgcccccggccgggctagaagccgccgcggcagc

SEQ ID NO: 1562 - DNA, 255 bp, Homo sapiens
ccagccccagcatcgcgcgccgcagccgcggccccgcagctccgcccccggcccggcccggccccgggcccgctcgcccgccgccccgcatggagctgtcagccatcggcgagcaggtgttcgccgtggagagcatccggaagaagcgcgtgcggaagggtaaagtcgagtatctggtgaagtggaaaggatggcccccaaagtacagcacgtgggagccagaagagcacatcttggacccccgcctcgtcatgg

SEQ ID NO: 1563 - DNA, 255 bp, Homo sapiens
ccacgcgtccggcacttccgcccatccccctccggatccctctgttcgggctcgggtttccgccgagacgacagggactgccaggtcggaagtagtgtgaggctcgtgggcggagccaagcgccgccatgtccgccgccctgctgcggcggggcctggagctgctggcggcgtccgaggccccccgggaccctccaggtcaggccaagccgagaggggctccggtgaaacggccccggaagacgaaggcaattca

SEQ ID NO: 1564 - DNA, 255 bp, Homo sapiens
gggcccgcagcttccgtggctgagaggagccggcggcggcagtgtctgtggtggccgcggcggcgagagcgacggtcccatctttcccaccctcttggttgccgctggccacacgccctccgctggcggcgacttctcagctccgtgcgcccgggctggacagtgagcctcgagaggagacgcgggcggctagagccggagtggggcgagccgcggaacccggccgggagccgcgcgaggcgtgatcggagggta

SEQ ID NO: 1565 - DNA, 255 bp, Homo sapiens
gaacaaatcaaatcgaagcaaagaaactgccggctttcaaaatcctcctcctccgccatcatccgccgcggtgcggagagcaggtggtgctggaagcgcgtgaggccgggagctcgagagagctaacagactagccggctggacatctggaccgctggatccggaggtggcgaccccggcctgacccggaccctaaatccgtccccgccccagagggcggaggcgcgcgctcgattccccccacgcggcggcgcc

SEQ ID NO: 1566 - DNA, 255 bp, Homo sapiens
gagggctgttggcctgctgctgtgctgctgaacagtatgcagtcctttcgggagcaaagcagttaccacggaaaccagcaaagctacccacaggaggtacacggctcatcccggctagaagagttcagccctcgtcaggcccagatgttccagaattttggaggtacaggtggcagtagtggcagcagtggcagtggcagtggtggtggacgacgaggagcagcagctgctgcggcagcgatggctagcgagacc

SEQ ID NO: 1567 - DNA, 255 bp, Homo sapiens
cggcctggccgcgtcccccgcgcgggccatcttggtcacggccggcggcggacagagccgcggaggaaccgcgagaccccagggcccagagcaggtccagccacccgtctggctccgtagtccgcgaagtctgcagtaaaggagccgcgtgggaccggggccgaagtccctagggcctggcaccgcgtgcccctctctcgggccctcggcttgggggtctcgcagcgccctgccgtcgtgcaccccacactgccc

SEQ ID NO: 1568 - DNA, 255 bp, Homo sapiens
cagtccctgctcgtcttttcatattgctcatggctgcttatattctagctgccaatccacccgcggcaccaagttcaccaaatcacttcacattgcagagcaggctgttacaaatccactgttacgggaaggccaccccatcctctctttgcctcgctccccaactggctcccctctcccccatctatcacttctattccctggtctctgcccacctgccgacccccgcagagcagtcccttcatgcacctgccc

SEQ ID NO: 1569 - DNA, 255 bp, Homo sapiens
actttccacgggtgaggcctggagaacgggtggacgtgcaggccagaacccgggacccacccggctgagcccccagactctccgctgcccacgaccctcggagtggcaccctctcctggccgtctcctctcgtgggtcccgaagaacgggtgcaaagccgagttcgtccgctgtactgcgcgggcgcgcgtttcgttcttcggttttgccacggttctgtgactccctaaaggttgagggctactgaattagaag

SEQ ID NO: 1570 - DNA, 255 bp, Homo sapiens
gggcgggccggctggctgggaagatggcggcgggaacctgggccgccgccgccgccgccgccgccgccgcggagcgaaccaggggtgtccggggtgcgcggtccagggccggggccgggccatgagcgcgccgtcctcgagtccccgagccgcggagcccgcccgcgcccctcgggccgccccgcgtccctcgccatggcgcggctcgcggactacttcgtgctggtggcgttcgggccgcacccgcgcgggagt

SEQ ID NO: 1571 - DNA, 255 bp, Homo sapiens
ttttgaaggcgtccacttgggggaaaaaaatgaaaggaaaaatatttcaacccggctgtcggtctaaaagaggagagaatgctttctttaaaaaagggtctgtgaattagttttcctgatctaacttctaattttctgtatgttctgccatttgtgggaaatatttcttcgtttcagattgttgatgttattgttgggaaagacgaaaaaggcagaaagatcccagaatatctgatccattttaatggttggaac

SEQ ID NO: 1572 - DNA, 255 bp, Homo sapiens
agcgcgctggcgggaggtttggagcagatggataccgtatcgacgtggggcctccggtatgttgccgctgcgttgaggtttagaaacatcaactggaatcaatttgcatttgaaaattagatcagcacaaagacttgatattgtggaatgactagcaaacaagcaatgtcatctaacgaacaagaaaggctcttgtgttataatggggaagtccttgttttccagttgtctaaaggaaattttgcagataaagag

SEQ ID NO: 1573 - DNA, 255 bp, Homo sapiens
agttaaaaacagatttcccacaagaccgaccggagcgccgatcagagcacctgcccgggccacacatttcctcctggagcacagcaagtgccgcctaaattacccgagtgagcatctcttcccggcacgagaggcagggaggccaaagggccgccaagctggcctgggagaggcgtagggcggagcgagagtggagtgacattcccgagggcggagccccagggcctccgagacccgtagactcccgcctcccgc

SEQ ID NO: 1574 - DNA, 255 bp, Homo sapiens
agcgcatgacgttattacgactctgtcacgccgcggtgcgactgaggcgtggcgtctgctggggcacctgaaggagacttgggggcacccgcgtcgtgcctcctgggttgtgaggagtcgccgctgccgccactgcctgtgcttcatgaggaagatgctcgccgccgtctcccgcgtgctgtctggcgcttctcagaagccgagacatggtcttgctacgttgcccagtctggtctccatctccaggctcaagca

SEQ ID NO: 1575 - DNA, 255 bp, Homo sapiens
attaaataagagaaaaaagcataaaaggagtaggcttttttggcagatactgttatatgggatggacaggaggggaagacatgaaaatcaactaaaatgaaatacataaaaaatcagtaaagagcctgcttacgaaagtggaaaaacaacagctgggcggggtcgcagggtggcaaacgtacgcgggcacgtgcacgtgcttttggggccgacagacgcgccagttgcctaggcgcatgcgtctggctatcccag

SEQ ID NO: 1576 - DNA, 255 bp, Homo sapiens
gtgcagcaaccgactccgcccagcgaggcggagcctagggaagccgcgggcggcccgccgctgtcctggagctgctgctgctgctgcggcggctgcaccggcggcgccgaggccgagatcgaggccggggtgcgcgcttcgcaaacgtgccctatccgtgcggcttggctgcgccagcccttgcggccacccgggcgtctaggcgggtctgtgcgccgcccgggcgaggatgcggctgttccggtggctgctgaa

SEQ ID NO: 1577 - DNA, 255 bp, Homo sapiens
gggccggaggggcggggtgagaaggctgcgcgcgggtaaaggggccgcctcgagcgcggtccgagcgttcagcggacgcgcgcggcctcgatctctggactcgtcacctgcccctccccctcccgccgccgtcacccaggaaaccggccgcaatcgccggccgacctgaagctggtttcatggcagcctcaaagaaggcagttttggggccattggtgggggcggtggaccagggcaccagttcgacgcgctttt

SEQ ID NO: 1578 - DNA, 255 bp, Homo sapiens
aaaggcagagtcatcccaggctctcacagtggaattaataataagctcacttgccacctcagtttcaagtcatctaaacctgtgtcattttttaccaatcttcttttctgtgatgacagaaaaaactggttttcacttccagttactgcaacagcagaaaactgcattcttactatttacccatatatggcaattcatctggataagcaaaacattattttaaagaatgataaggatgaatatcttaagaagact

SEQ ID NO: 1579 - DNA, 255 bp, Homo sapiens
ctggacgagtccgagcgcgtcacctcctcacgctgcggctgtcgcccgtgtcccgccggcccgttccgtgtcgccccgcagtgctgcggccgccgcggcaccatggctgtgtttgtcgtgctcctggcgttggtggcgggtgttttggggaacgagtttagtatattaaaatcaccagggtctgttgttttccgaaatggaaattggcctataccaggagagcggatcccagacgtggctgcattgtccatgggc

SEQ ID NO: 1580 - DNA, 255 bp, Homo sapiens
gcggccgccttagcgcccggtgcttgggtcggcgccgggagcgaggagcgagctacttcaaagccaccaggcctggagcggggacagaggcggcgactaggggaaggtgaagccgtcgctgcaggaggaggagcaggaggaggtgacgcaggagaaacgcaccgcccggagcccgtctgagctcagcgagagccccagcctgaggggagaaggggaagagggccgtcgccggccaaggaggaggaggaggcgggc

SEQ ID NO: 1581 - DNA, 255 bp, Homo sapiens
gggtcgtcagggcgacgaaaaaggggaaggggtgctgggcctggcgggcaaactaaggctgcggaccgttgggcggttccgcggggcgttgtccggagagctgcgaggccggggttcccagggttcacgccacactctaggaagtgcctgagctagtgagctggccaacgagctccgcgggctgggaccatgggctgcttcttctccaagagacggaaggctgacaaggagtcgcggcccgagaacgaggaggag

SEQ ID NO: 1582 - DNA, 255 bp, Homo sapiens
atggcagtagccccgcgactgtttggggggctctgcttccgtttccgggaccagaatccggaagtggctgttgaggggcgtcttccaatctcgcacagctgcgttggctgtagaagagaacggacggcgatggcgacggtcgcagcaaatccagctgctgctgcggcggctgtggcggcggcagcggcggtgactgaggatagagagccacagcacgaggagctgccaggcctggacagccagtggcgccagata

SEQ ID NO: 1583 - DNA, 255 bp, Homo sapiens
gaacactgctcccttcgctttgctgtcccttcctctccccaccactccgctcctgctggcctcagccaatcagcacgcacgccgggacgcgcaaggggaacgttccgggacgttctcgctacgtactctttatcaatcgtcttccggcgcagccccgtccctgttttttgtgctcctccgagctcgctgttcgtccgggttttttacgttttaatttccaggacttgaactgccatgtcctctgaagaaggaaag

SEQ ID NO: 1584 - DNA, 255 bp, Homo sapiens
aaatcgatcttggcctcggaagaaaaagaacaaagaatcgctggcaacttgcgcgtcgcgtcgctgcagccacgcagtgcgtggattcagccgctttggccgtgcccgttgcatgccgggaaacgcagttcgcgagccccggatacgtcgacaatagatgacggggctcacgttgtacgttcacatcaggtcccggcccgccggaacctgggcgatccacgatgccgagtttgccacgctgcgacagcccatagg

SEQ ID NO: 1585 - DNA, 255 bp, Homo sapiens
tcctcttcttaccctgcacccagagcctcgccagagaagacaagggcagaaagcaccatgagtgggggcccaatgggaggaaggcccgggggccgaggagcaccagcggttcagcagaacataccctccaccctcctccaggaccacgagaaccagcgactctttgagatgcttggacgaaaatgcttgacgctggccactgcagttgttcagctgtacctggcgctgccccctggagctgagcactggaccaag

SEQ ID NO: 1586 - DNA, 255 bp, Homo sapiens
tccggccccgcccgcgtcagctctgcgcggtgattcactccctccttcgccccggggcccccttcccggccagacggcgggcaagacagctgggtgtacagcgtcctcgaaaccacgagcaagtgagcagatcctccgaggcaccagggactccagcccatgccatggcggattctgagcgcctctcggctcctggctgctgggccgcctgcaccaacttctcgcgcactcgaaagggaatcctcctgtttgctg

SEQ ID NO: 1587 - DNA, 255 bp, Homo sapiens
gaacgccagagcgaggtggtgaggagagctggttgcgtgagtctcctcagctctgcttaccggtgcgactagcggcagcgacgcggctaaaagcgaaggggcgagtgcgagtcccctgagctgtacgaacgcggtcgccatggaccgcccagatgaggggcctccggccaagacccgccgcctgagcagctccgagtctccacagcgcgacccgcccccgccgccgccgccgccgccgctcctccgactgccgct

SEQ ID NO: 1588 - DNA, 255 bp, Homo sapiens
gcgggaccacttccggcctagagaggggagggcagtctccgagtttcggaggggcttggagtgagtggacgcactcgggaattgtaggaggacgaggctcagctcttgccaggccaaattgagacatgtctgacacaagcgagagtggtgcaggtctaactcgcttccaggctgaagcttcagaaaaggacagtagctcgatgatgcagactctgttgacagtgacccagaatgtggaggtcccagagacaccga

SEQ ID NO: 1589 - DNA, 255 bp, Homo sapiens
tgccagagttgctgggagtgcgcgcggtcggatcacaaggcggcggcggaggaggcccagagaccggagcgcggagacctcagccagcggcctacgcccaggcctttctccaccggaggaccagggaaccgcagtcttcatcacagaggtaccgtgctccgcgctccccgcctgacccggcccagcccgctgcggcggtgcctccttccttcctccttccctcgcgctctctctttcgcccgcccgcgccttccc

SEQ ID NO: 1590 - DNA, 255 bp, Homo sapiens
ccctcggtgcgcgggcacagcagccaggctgccggagagctgatctcggggattcgggtgcggagcccttggcctggaggcgatatgggtggtccgtggcccggttcagtcgcttgcagcagcccggggaacaggcctgtctggccctgagggagtcccctttctgaagctgtggtgcttggacgacctgctctctacattgctgggcacctgtaggtgtccctcgagagctcagttttgaggttcaagtcagtg

SEQ ID NO: 1591 - DNA, 255 bp, Homo sapiens
ttcccagtggttgcaataacggacttagaggtctggacaattcaagtaaggaacaaggctcgcttatccaagttctcgcaggataaaagtttgttatgaacgatttcacatggtttctctttatcagaaagttgttagggacttttaatcgcagaattggcctcgggtgcccacgctctagtattgaaatggcggttttgggacaaataagcaacatccgtgggagtggaaagcgacagacctgatcccggaagc

SEQ ID NO: 1592 - DNA, 255 bp, Homo sapiens
acgtctggtgtgggcgggagtgagccaaagtgtgctaaaggaaaccaacagcggcctaggggtgaaaggacagccagggttagatgttctgaggaggcgggagcaaccgagagagcacgtgagcatctgtcctttctacccgttcctctttatctttagtgttcagtagcagcggggatagcccggggcccggtgtatggccacggagttacagtgtccggactccatgccctgtcacaaccagcaagtaaactc

SEQ ID NO: 1593 - DNA, 255 bp, Homo sapiens
gtcaatcacctcagatctctcaagcagtccagcctacgcaacagtactccacctctgcgcctgtgcggggagggtaaggcggggccagcaacttcctcagctggagggagagcgcacggtggagccgccagttgagaaggactctgatccggctcagctttccaatcagctgcggaaggagccacgctttcgggggttgcaagatggcggccaccagtggaactgatgagccggtttccggggagttggtgtctg

SEQ ID NO: 1594 - DNA, 255 bp, Homo sapiens
ccgccgcggcggggggtgggaaaagagaagcagagggaggagttgttgctgccgccgccgcagccgcagctactgtgacttctccgattgtgtgagctttgttggagcctgcgtacgtggatttatcgctgccacggtctgcgtagctccagaggtttaaccataggatagagaaaccaggaatgtaatgaggaaatcaaaatggatccaagtatgggtgtgaattctgttaccatttctgttgagggtatgact

SEQ ID NO: 1595 - DNA, 255 bp, Homo sapiens
ctcggctgcgggagtaggaagcagctttgcgcgcccgggcggccgatgcgggcactttgaagaatcacgtgtgttgaggccctcttaaagagataggcacctacttttccctccaccctaaacaccgccctgagggcggcggcgaccgtggtaattgcaactgctcaggggcagggcttgccccagcgccgagtagtggcaacggcgtggttgcgtcgggggtgcctgggagcctggagtcccgggggcctgaaa

SEQ ID NO: 1596 - DNA, 255 bp, Homo sapiens
ggcttgtgctccgtacggaagtgtgctttggcgcaccggaagccgactcaacagagctatggcgggtttgactgtgagagacccagcggtggatcgttctctacgttctgtgttcgtggggaacattccttatgaagctactgaagagcagttgaaggacatcttttctgaggttggacctgttgttagtttcagattggtatacgatagagagacaggaaagccaaagggttatggcttctgtgaataccaaga

SEQ ID NO: 1597 - DNA, 255 bp, Homo sapiens
tgaccaagagctgacgtgtgcagaagtccttcttgtcctggtcgttgttcccgtctgagtaccagctccccactgccctgagggcgggccggcctgcggcggagggaaaaaggaagaggagaaggaaattgtcccgaatccctgcagtgggtccaagcctctcccgggtggccagtctttctgtaggttgcggcacaacgccaggcaaaagaagaggaaggaatttaatcctaatcggtggaggtcgatttgagg

SEQ ID NO: 1598 - DNA, 255 bp, Homo sapiens
gaacttcgaaagactggaacacttccgcctgtcaggccagaagagatttcctgacaccacagctggaaacccatgtgcatttcagttcaggaaagaatgcgccgttttccctatatccggaattcgtccctgcgcattccaatacctgaagcggccacagggtacaggacagggagccctccgacagaaaagagtcgcggcgctaaacaaagcctgatatcactccgcttccataagccggatccccataaacta

SEQ ID NO: 1599 - DNA, 255 bp, Homo sapiens
gacaccctcgcggagagcggttcttgccgcatcctgcgcagcccctgcccagtttggtgcagaggcgtggggggcgggactcgtctttgccattcggatcgctgggaaagcggtgggaatccaactgaagagcagccagaggagagctgaagagaggagggggaggccgatgacctgggctctgggcctctgaagcctggcaacgaggagacgatccgttcggagccgggcgctagagagaggtctggcgtattc

SEQ ID NO: 1600 - DNA, 255 bp, Homo sapiens
aggcagttgcgggttgcaggagttcaggaaaggaggtgggactagagtcaacctggaatagctctacagtaacaatggcagcctttttgttgctgggacatccatacaggcaacttagctggtgaaaggactctggattggttggcagtctgcttttttttttccaaggtgatcactttactgtagaagaaatgaggttaacagaaaagagtgagggagaacaacaactcaagcccaacaactctaatgcaccca

SEQ ID NO: 1601 - DNA, 255 bp, Homo sapiens
acgtgggagagaagggagggttgggggaagtgtggaaaacctgaacctgagctgctgtcgcctgaggaagatttggtgggaggagaagcagaggggaagagacgggttgagagtgaggtgaggagggcatctaggtcactgctcccggggggcacaaagttcgcgatgtggctgaagcctgaggaagtgcttctgaaaaatgcgctgaagctgtggctgatggaaaggtccaacgactacttcgtgctgcagcgg

SEQ ID NO: 1602 - DNA, 255 bp, Homo sapiens
gtttctccggtcactcctgccaggggagaagacatgtaaacgtgcctccagaggaagggctgggggagctgggagtggcgggggcggcggaaggtgagcctgggaaggtggccgagcaccccttcttcttgggcccttcccagtgctcccttggggtgtcagccccagccccgtttgcccccactccgcctcccttttggaagggattgccttttttttcctctgcggcggcggaaatgacagtgtggtgctgcc

SEQ ID NO: 1603 - DNA, 255 bp, Homo sapiens
gcagtgagtccacccgcccgccgaggtccgcccgcccgccgagacccgcccgccgccgctgccatggccgaagtgcgcaaattcaccaaacggctcagcaagcctggcacggcggctgagctccggcagagcgtgtctgaggccgtgcggggctccgtggtgctggaaaaggccaaagttgttgagcccctggactatgagaatgttattgcccaaagaaaaacccagatttacagcgaccccctccgagatctg

SEQ ID NO: 1604 - DNA, 255 bp, Homo sapiens
acgcctcgtctcctcccgtgtccctcttcccatggagtcagtacggatcgaacagatgctgagcttgcccgctgaggtcagcagcgacaacttggagtcggcggagcgaggggcatcagcggcccaagtagacatgggcccccacccaaaggtggctgcagagggccccgcacctctaccgacgcgggagccagagcaagagcagtctccggggacctcaacgccggagagcaaagtcctgctcacgcaggcaga

SEQ ID NO: 1605 - DNA, 255 bp, Homo sapiens
tagtcttctctctttcttaagcagtgataaaccttttaatgagaacaaaaaggaaataaattgctaactctgaaggaaccagtaagaaatacactgaagtatggtctgttgttttagaataatttgttaaatggaccagagtaatatagtggaacatgcatcaccttataccatatagtaactgattcttctaagtttacttgaacagatttcagtcaggaaaaaacattgctcaattgtgttcttcaatttatt

SEQ ID NO: 1606 - DNA, 255 bp, Homo sapiens
attactaagcatccccgtctgagtgcaagggtgtgtgttggcagtacagccccaatcttgcaaaatccttcttccaatgttcctcccctctctgtatgaaccctgtgttggggggcagaagatggaagcccttggcaagctcgatcgaaccaagctactaaattgctgagctcgttttaactgaagtgtgagaaggaggtttaaggcaagtagacaacatcctgttgttggggtgcttctctcttttttgcacat

SEQ ID NO: 1607 - DNA, 255 bp, Homo sapiens
tctcagctcccagctccccgctcccggctcccggcgcccggcgcccggcgcggagctgttcctcaaacgacacgcagccgaggtgggtgggtgtggggacgcgggagccagtgtcgtcggatcggcccgcagtccgctgtcctgctgagcccggaggccgcctggatggagccgccgctcccggtcggagcccagccgcttgccactgtcgagggtatggagatgaagggtcctctccgggagccctgcgccctg

SEQ ID NO: 1608 - DNA, 255 bp, Homo sapiens
gcttaacggtcctctggtctctctctcccctcagctgagtcccttccctgtctttcactcttctggcatcggtggttttacttcttcgattgaaccctgcttcctcgacccccctgggaggccgccttcttcaggcgcctcccttctctccacgagctcgctctgacagctgaggaactggcaagatcctgctacccagagggtgaatgggtatctttcccggaataatcctaatttttctaagggtgaagtttg

SEQ ID NO: 1609 - DNA, 255 bp, Homo sapiens
ggcggggcctgcttctcctcagcttcaggcggctgcgacgagccctcaggcgaacctctcggctttcccgcgcggcgccgcctcttgctgcgcctccgcctcctcctctgctccgccaccggcttcctcctcctgagcagtcagcccgcgcgccggccggctccgttatggcgacccgcagccctggcgtcgtgattagtgatgatgaaccaggttatgaccttgatttattttgcatacctaatcattatgctg

SEQ ID NO: 1610 - DNA, 255 bp, Homo sapiens
actttgacagtcttctcatgctgcctctgccaccttctctgccagaagataccatttcaactttaacacagcatgatcgaaacatacaaccaaacttctccccgatctgcggccactggactgcccatcagcatgaaaatttttatgtatttacttactgtttttcttatcacccagatgattgggtcagcactttttgctgtgtatcttcatagaaggttggacaagatagaagatgaaaggaatcttcatgaa

SEQ ID NO: 1611 - DNA, 255 bp, Homo sapiens
cgccgcctgtgcagccgctgccgccgccgccgccgccgccgccgccgccgccgccgccgccgccgctgccgccccggctgccgcgccgcgccgctgcctctgccccggccgcccccgccgccgctgccgccgccggcccgcagccagccaggcgggcggcccagcccgcctgagcccgcagcggctgccgccgcagcgtcgggtcgctgggtgcgcgggctaccgcggaccgagcggacccgagtgggcgaccag

SEQ ID NO: 1612 - DNA, 255 bp, Homo sapiens
ggggcccagctggtcgcggtccccccctcaacatggcggcagcggtgctctaggcgccggaagggggcgtgaatcggtgcgaccgcgcgcgtgcgcagtaccgggtccgcgcctgtccccgaaacttcgcaccccgtcgaactctcgcgagagcggtatctgcgtgtcgggacgtgcggaggctctcactttccgtcatggcgctgaaggtagcgaccgtcgccggcagcgccgcgaaggcggtgctcgggccag

SEQ ID NO: 1613 - DNA, 255 bp, Homo sapiens
cacggcgcgggcgtcagctgactgttcggccgccaccgccgctgccgctgccgctgtcgctgtcgccgccgccgccgcccgccgccgccgccgccgccgccgccgctgccatggctcaatacaagggcgccgcgagcgaggccggccgcgccatgcacctgatgaagaagcgggagaagcagcgcgagcagatggagcagatgaagcagcgcatcgcggaggagaacatcatgaaatccaacattgacaagaagt

SEQ ID NO: 1614 - DNA, 255 bp, Homo sapiens
agcaaatcgcattgcgcagacgaccagcgggcgcctcggattccgcccccgggatggccccgcctcctcccgccccgcggcaaggcacgcacagggcagtgcgcgggtgggtgggtcctagcagcgcggcctgacgggaccaaggcggcgggagtctgcggtcgttccctcggctgtggaccgggcggcacgcacgcggtgcagggtaacatggcggatgcggaagtaattattttgccaaagaaacataagaag

SEQ ID NO: 1615 - DNA, 255 bp, Homo sapiens
cccagatcccgcagctgagagggcggaagccttggcactagcggcgcccgggcgcggagtgcgcagggcaaggtcctgcgctctgggccagcgctcggccatgcgatccgccgcgcggaggggacgcgccgcgcccgccgccagggactctttgccggtgctactgtttttatgcttgcttctgaagacgtgtgaacctaaaactgcaaatgcctttaaaccaaatatcctactgatcatggcggatgatctagg

SEQ ID NO: 1616 - DNA, 255 bp, Homo sapiens
gtcggcgaggagggtccggccggagttgaaggattgaactttccggctcagtcgcggcgtctgcctggtcctcagcagtgcagccccggcgcggagcagggagcctcggcccgcgcccggcgccctcgccctcgccctcgacccgcagccatggtgcccggggtgcccggcgcggtcctgaccctctgcctctggctggcggcctccagcggctgcctggcggccggccccggcgcggctgctgcgcggcggctg

SEQ ID NO: 1617 - DNA, 255 bp, Homo sapiens
ctggggcccagtgcgtccagagcggagggtgacgggagctgcctgtgctggaggaatcactttttaggcgcttgttttggaccattgcacaaacccgggtgcaaaccccaagctcaccagcgtgagtgagctgggccagcagcagggaggagaggggaaggtgggcgaggagggcgccgcgcaccccgaggcccgtgtgggcggtgggaagatcccgggggcggctttggacagccccggcagcgaccccttccc

SEQ ID NO: 1618 - DNA, 255 bp, Homo sapiens
atgccgctggcgcagctggcggacccgtggcagaagatggctgtggagagcccgtccgacagcgctgagaatggacagcaaattatggatgaacctatgggagaggaggagattaacccacaaactgaagaagtcagtatcaaagaaattgcaatcacacatcatgtaaaggaaggacatgaaaaggcagatccttcccagtttgaacttttaaaagtattagggcagggatcatttggaaaggttttcttagtt

SEQ ID NO: 1619 - DNA, 255 bp, Homo sapiens
gggagtcgagtgagcgcggcgccgcgagcgggctgcgggcagccggggaccgcaaactttgctgctcgccgcgcttctccggcccggctccttctccgctcgttaacgtcgccaaccccccccacccctcatatctctctccacccacccaaccgccccccgctccttctcgccgcctcgagtccgcttgggggaaaacttcaaagagccggatcgcaggctccctgcctactcccccaccggggatttcagact

SEQ ID NO: 1620 - DNA, 255 bp, Homo sapiens
gcgccggcgcgcgaggggcggggtgaaaggtcacagcgcggcagcgggtctggctggcggcagcggcgggagggagccgagagacccgagtgcacgtgtggagaagcggcggcacaagcgcggcggcgggagacactcccgcccccaccagactcaagccctcactcgactctcgcggccttcgttgctcgcacagctccctgcccaggctaggaggccggcttgcggggttgagtggcccgagctaagggtgcg

SEQ ID NO: 1621 - DNA, 255 bp, Homo sapiens
cggaggctccccggtagggacggcctgaggccgagggcaccctgagggcggaagaggcaaagcgcctcgcccgccggggcctcggaggtgactaactcctagaggctgcggcggaggggagaagcctggtggtacattccatggcccagtgcctcggccactggaaaatcccacaggggtatatcgagtaggggaccgcgggctccgcggcagaaatgaccgcccttccaagatggcggctcccgtagagacact

SEQ ID NO: 1622 - DNA, 255 bp, Homo sapiens
ccgggttctctcccggcgtgccccgcgccgggtttgttggggggtactcggcagtgcagccatgactatactccccaaaaagaagccgccgcctcccgacgccgaccccgccaacgagccgccgccgcccgggccgatgcccccggcgccgcggcgcggcggaggtgtgggcgtgggcggcggcggcacgggcgtgggcggcggcgatcgcgaccgtgactccggcgtcgtgggggcccgtccgcgagcttcgcc

SEQ ID NO: 1623 - DNA, 255 bp, Homo sapiens
agaggaggaggagaactcaggcagctctgcagagggggccaggagctcgggtgtttggtacccccagccccaccgctgttgctgctcctgcagcggggacacaggtgaggacgccccgagagagagggggagggggaccaccactagcgctgtcctcatccttccctggtccagcccccacgccctaacccatcctgggatagtccccaggggtcccactggaccttgcccttcccaggcctccttccagggacc

SEQ ID NO: 1624 - DNA, 255 bp, Homo sapiens
cagacaaggacagaaagggggctggaggagaaagagagagagagatacagagagagagagagagagagagagagagagagagagagagagagagagagagagagagagagagatcagccctggtgagggaggaaaactccatagataatacagggagctcctgcaggaagactcagggagaagatcccagaacttaccctaagactgttgagagagtagggggtagctttgcaggacctggtttgggggtcatca

SEQ ID NO: 1625 - DNA, 255 bp, Homo sapiens
gtgtagcgccagcgcgctgtgacgtaatgtgaggggtctcccggcagggctgagctggaccaatgaggaaaggcaaggggccgatttgcctgttctcacgccccaccctcagacctagccggagcaaagtttcacttatagaagggagaggagcgaacatggcagcgcgttggcggttttggtgtgtctctgtgaccatggtggtggcgctgctcatcgtttgcgacgttccctcagcctctgcccaaagaaaga

SEQ ID NO: 1626 - DNA, 255 bp, Homo sapiens
tctctctctctctcactcactcactctctctctccctctccctctcctctccttcctcctccgcctcctcagctcttgggctagaatatctatgggtcgaaacgtgatgcgatgaattcgagagagagcgaaactaggacgaggagtgcggcggaagcggcgggactcccgggcatgggggcttcaccacaatagaggcagcgcccccacccgcccccgccagcccctccggagcgaagcccccaaaccccctcg

SEQ ID NO: 1627 - DNA, 255 bp, Homo sapiens
aggggaggagaggagaacttagagaaggaaggcggcgggtgtcagggctatgagtgcttttaaggaaggtctccatagaaggttcccccagcaaagtagggaggggtactccccgagaggagtcgaggtgccggagcctgctgcctcgccgacgctgggaggagccccgtgtcccgccgcgcttgccaagggttggctgcgcgtgcggcgggagtagaggcgccttgcgcaccaggaagtgactgtttccccgcc

SEQ ID NO: 1628 - DNA, 255 bp, Homo sapiens
aaacaataacgtcattatttaataagtcatcggtgattggtccgcccctgaggttaatcttaaaagcccaggttacccgcggaaatttatgctgtccggtcaccgtgacaatgcagctgaggaacccagaactacatctgggctgcgcgcttgcgcttcgcttcctggccctcgtttcctgggacatccctggggctagagcactggacaatggattggcaaggacgcctaccatgggctggctgcactgggagc

SEQ ID NO: 1629 - DNA, 255 bp, Homo sapiens
ttgattatggaacattctaaaacttagacaagacgattgtgattggctgaagggcatacgccctcctccagggtgacgtgtctgcctatggatatcagttgccagagaaacctggctttactatggcggttggaggaacggcagtgatcacacgtcggctgctgggaagatctggattctcgtttcaggtcaccatcagaaaagctaagtttgctgtatagtgaggatcaggagatctgatcctgattgcagaac

SEQ ID NO: 1630 - DNA, 255 bp, Homo sapiens
agaaaagggaacgaggaaggccggtgattggtgaagctctaacggctgttttgactggcgtagccggagccggcgacgtgaggcgggcgttgctcgcgcgacaagtagttgctgggacagcgaaatggaggggtgtgtgtctaacctaatggtctgcaacctggcctacagcgggaagctggaagagttgaaggagagtattctggccgataaatccctggctactagaactgaccaggacagcagaactgcatt

SEQ ID NO: 1631 - DNA, 255 bp, Homo sapiens
gcgattcggctggctctgccacaccaccgcgcgcccccgctccgcccgcccctccgggcgcgtcttttccgggctcgcgctgagtcccgcctccgccggctgtccgggtgcgcgcgcgccgctgcggctttttctctggcctccgccgcgcgctcctcctcgtcccagcgctagcgggcacgcggttcctttttgcgagctttccgagtgccaggcgccggccggctgcgaagacgcggtgggccgcccctccga

SEQ ID NO: 1632 - DNA, 255 bp, Homo sapiens
aagaaagagccccgcccctagtcttatgactcgcactgaagcgccgattcctggcttttgcaaggctgtggtcggtggtcatcagtgctcttgacccaggtccagcgagccttttccctggtgttgcagctgttgttgtaccgccgccgtcgccgccgtcgccgcctgctctgcggggtcatggtgtgcttccgcctcttcccggttccgggctcagggctcgttctggtctgcctagtcctgggagctgtgcgg

SEQ ID NO: 1633 - DNA, 255 bp, Homo sapiens
agactcgctgagtcgctcctgcagaaagggggggagagagatcgaaaagcaggggagggggacggcacggccgtttacctgtctgcctcctcattcgctctcccccctcgttctgctcactcctggtgtcagcctatccgccttcccaaaccctcccattcccccggtgtagccccccccttcactttccttctcgtcctctgtgtttctcctctcttctttcttcccttccccctctagcattgctaccttctc

SEQ ID NO: 1634 - DNA, 255 bp, Homo sapiens
gactgcttgcattaaaggacttcctcatcctttttttcatgaaactgagcttgcttaatcagagatggagcaaactgactgcaaaccctaccagcctctaccaaaagtcaagcatgaaatggatctagcttacaccagttcttctgatgagagtgaagatggaagaaaaccaagacagtcatacaactccagggagaccctgcacgagtataaccaggagctgaggatgaattacaatagccagagtagaaagag

SEQ ID NO: 1635 - DNA, 255 bp, Homo sapiens
atttgcatctctccctccaacttgccattggcggcgcgaagtgtgggagagccctgcgcctcgcccgcccggaccagcctgccccggcgccgaggtcgctcctgtggttggtccagcccagaatgcagccttgagcctggcttaggccaccacctactccagctctctccaccccctattttactgcagctcagggggtaggctctaggctccaaagtacctgggtattgtcccttcatcaagaaagccccacag

SEQ ID NO: 1636 - DNA, 255 bp, Homo sapiens
gggaaacccttccgggtgtgtgcttggtgggggtgggggtgggggtgggggtgggggtggggggtgggtgagaaaaaaaagaggtgggttcgcctggagtccctgcggccgccgcggaaggcccccgcttctttccccgcggcgagcagcagcgctggggcagcggagagacagaggagccagcgggtggccatggccttggcgtgacagagcctccccggcggccgggcgggtgcggacggcggggccggacga

SEQ ID NO: 1637 - DNA, 255 bp, Homo sapiens
caccctcgacatgcgcttccggcgacgccttagcgctgacccccacgcaacccagcgaaactccgcggagcgcgcgcggcacgatggacggtcgggtgcagctgatgaaggccctcctggccgggcccctccggcccgcggcgcgtcgctggaggaacccgattccctttcccgagacgtttgacggagataccgaccgactcccggagttcatcgtgcagacgagctcctacatgttcgtggacgagaacacgt

SEQ ID NO: 1638 - DNA, 255 bp, Homo sapiens
ccggtcgcgtgcggacacaaggatggggacctcccagcgaggagcgctctgggcggggctccggacgcatgcgcggccctcgtacggaagcccggaaggaggggcagggggcggtggctcaggtttctccgggcggcggcggcggcggcggcggcggcggcggcggcggcggcggcgacggcgacggcgacggcagcggggacggcagcagtagcgggagcagcagcgtggacgcggctggcgctggcgccatga

SEQ ID NO: 1639 - DNA, 255 bp, Homo sapiens
gaccggctccgcgcattggcccgccccgtgcgctggcctgtcccgcgcattggccaagcggccgggaggacgggcccggcggccgtgcacttccggccggtggccggcccggcgcgcaccgccccttccgccgtcgcccagcgagcccagctccggtcccagccccggccgtcccggcgtcgcttcggagcgcggcggcagctgactgcgccttcacgatccgctgggacccgcgagccccgccgccgttatgaa

SEQ ID NO: 1640 - DNA, 255 bp, Homo sapiens
cgcggacccggccggcccaggcccgcgcccgccgcggccctgagaggccccggcaggtcccggcccggcggcggcagccatggccggggggccgggcccgggggagcccgcagcccccggcgcccagcacttcttgtacgaggtgccgccctgggtcatgtgccgcttctacaaagtgatggacgccctggagcccgccgactggtgccagttcgccgccctgatcgtgcgcgaccagaccgagctgcggctgtg

SEQ ID NO: 1641 - DNA, 255 bp, Homo sapiens
gtactctggcggggaaggagaggtcaggcgctccgggctcgcccgctaggtcggggccgcggcgtcccccaccctaagtcccacctccggccgggcatgggtacccgggcgggcctgcctcggcctgggcccactcactggtccagaagcagctgtaggtgcccaccaagcccatgacgacgctgctggccagggtccagagcgcttgcatcaaacacccctaactcagaagtgtgcagccacactgggactcag

SEQ ID NO: 1642 - DNA, 255 bp, Homo sapiens
cgcaatttccactcgcggggagcagcagcagcagaggcagcagcgggcggcgctgagccgccgccgccgccactgaggaagaagccggcccagccgccgccgcgtccggaccctcgcgcctggatcccagcgccccgatcccggcgccccaacccccacgcccgcctccgccaactttcacgctgcctcggcggcccggcccggctcgacgccaatggtggaggccatagtggagtttgactaccaggcccagca

SEQ ID NO: 1643 - DNA, 255 bp, Homo sapiens
gatcacaggtctatcaccctattaaccactcacgggagctctccatgcatttggtattttcgtctggggggtgtgcacgcgatagcattgcgagacgctggagccggagcaccctatgtcgcagtatctgtctttgattcctgcctcattctattatttatcgcacctacgttcaatattacaggcgaacatacctactaaagtgtgttaattaattaatgcttgtaggacataataataacaattgaatgtctg

SEQ ID NO: 1644 - DNA, 255 bp, Homo sapiens; identical to SEQ ID NO: 1643

SEQ ID NO: 1645 - DNA, 255 bp, Homo sapiens
ggaagaagccgaaggggagtcggcggcacaaaatggcggcggcggcggcggcggctggtgctgcagggtcggcagctcccgcggcagcggccggcgccccgggatctgggggcgcaccctcagggtcgcagggggtgctgatcggggacaggctgtactccggggtgctcatcaccttggagaactgcctcctgcctgacgacaagctccgtttcacgccgtccatgtcgagcggcctcgacaccgacacagaga

SEQ ID NO: 1646 - DNA, 255 bp, Homo sapiens
aaatgtagtcactgtcccggaacctggggcagcggagtcccgtgcgccctgtggtgacagctcaggagggtgtgtgcgctcagcaggggccagcatggaccagtctgtggcaatccaggagacgctggctgagggggaatactgcgtcatcgcggtgcaaggtgtgctgtgtgagggggacagccggcagagccgcctcctgggactcgtgcgctaccgcctggagcacggcggccaggaacacgctctcttcct

SEQ ID NO: 1647 - DNA, 255 bp, Homo sapiens
ggttttcaggagcccgagcgagggcgccgcttttgcgtccgggaggagccaaccgtggcgcaggcggcgcggggaggcgtcccagagtctcactctgccgcccaggctggactgcagtgacacaatctcggctgactgcaaccactgcctccagggttcaagcgattctcttgcctcagcctcccaagtagctgggattacagattgatgttcatgttcctgacactactacaagattcatactcctgatgctac

SEQ ID NO: 1648 - DNA, 255 bp, Homo sapiens
gaggcaggactgcccggcccagccttggaggaagacttctgggcagaagcggaacacaggagcagagacacatagtcttggctccagtttcgtttcagttatgcccaccctttcagtgttcatggatgtgcccctcgcccacaagctagagggcagcttgttaaagacctacaaacaagatgattacccgaacaagatattcttagcctatagagtctgcatgacaaatgaaggccatccctgggtttctctcgt

SEQ ID NO: 1649 - DNA, 255 bp, Homo sapiens
gtgcgcagccgcgcggcattctggggccggaagtggggtgcacgcttcgggttggtgtcatggcagctgcggggagccgcaagaggcgcctggcggagctgacggtggacgagttcctagcttcgggctttgactccgagtccgaatccgagtccgaaaattctccacaagcggagacacgggaagcacgcgaggctgcccggagtccggataagccgggcgggagcccctcggccagccggcgtaaaggccgtg

SEQ ID NO: 1650 - DNA, 255 bp, Homo sapiens
agtatgtcttagatcttggatagctcagattttttaaatttaaagctagtcacagatgtaattctcaactagccaaagtgaagaaagcccaatttgggacaacgtctaaaataagaattgctagaaacttatgtattaggcatctgttactggttatttccaattctgactttttaaaatgtagggtttttttttttttttaaaccagtacacatctggaggcatacacattgaagcaaatacagctgtggttat

SEQ ID NO: 1651 - protein, 255 aa, Homo sapiens
MDSVMPSQEPPVDDKNEDADLPSEETDGIAYISSSRKHDSIKDDSEDLKPVIDGMDGIKISQGLGLQDFDLIRVIGRGSYAKVLLVRLKKNDQIYAMKVVKKELVHDDEDIDWVQTEKHVFEQASSNPFLVGLHSCFQTTSRLFLVIEYVNGGDLMFHMQRQRKLPEEHARFYAAEICIALNFLHERGIIYRDLKLDNVLLDADGHIKLTDYGMCKEGLGPGDTTSTFCGTPNYIAPEILRGEEYGFSVDWWALG

SEQ ID NO: 1652 - protein, 255 aa, Homo sapiens
MEAAAGGRGCFQPHPGLQKTLEQFHLSSMSSLGGPAAFSARWAQEAYKKESAKEAGAAAVPAPVPAATEPPPVLHLPAIQPPPPVLPGPFFMPSDRSTERCETVLEGETISCFVVGGEKRLCLPQILNSVLRDFSLQQINAVCDELHIYCSRCTADQLEILKVMGILPFSAPSCGLITKTDAERLCNALLYGGAYPPPCKKELAASLALGLELSERSVRVYHECFGKCKGLLVPELYSSPSAACIQCLDCRLMYP

SEQ ID NO: 1653 - protein, 196 aa, Homo sapiens
MSEGDSVGESVHGKPSVVYRFFTRLGQIYQSWLDKSTPYTAVRWVVTLGLSFVYMIRVYLLQGWYIVTYALGIYHLNLFIAFLSPKVDPSLMEDSDDGPSLPTKQNEEFRPFIRRLPEFKFWHAATKGILVAMVCTFFDAFNVPVFWPILVMYFIMLFCITMKRQIKHMIKYRYIPFTHGKRRYRGKEDAGKAFAS

SEQ ID NO: 1654 - protein, 255 aa, Homo sapiens
MLLCTARLVGLQLLISCCWAFACHSTESSPDFTLPGDYLLAGLFPLHSGCLQVRHRPEVTLCDRSCSFNEHGYHLFQAMRLGVEEINNSTALLPNITLGYQLYDVCSDSANVYATLRVLSLPGQHHIELQGDLLHYSPTVLAVIGPDSTNRAATTAALLSPFLVPMISYAASSETLSVKRQYPSFLRTIPNDKYQVETMVLLLQKFGWTWISLVGSSDDYGQLGVQALENQATGQGICIAFKDIMPFSAQVGDER

SEQ ID NO: 1655 - protein, 100 aa, Homo sapiens
MSTGPTAATGSNRRLQQTQNQVDEVVDIMRVNVDKVLERDQKLSELDDRADALQAGASQFETSAAKLKRKYWWKNCKMWAIGITVLVIFIIIIIVWVVSS

SEQ ID NO: 1656 - protein, 155 aa, Homo sapiens
MELPAVNLKVILLGHWLLTTCFWRHFSAKPRLETIELTCALCKLRSAAHRATAGLHCILRLLCLGQLHHPGLGRVGCGSAGLHRRHKHVSGWLAGHHLPGHRAHQHLLPAGQPHGHGPLWRGHGHPQLAAQAALLLLRLPHVPGARGFPWVFSGP

SEQ ID NO: 1657 - protein, 255 aa, Homo sapiens
MLEGLVAWVLNTYLGKYVNNLNTDQLSVALLKGAVELENLPLKKDALKELELPFEVKAGFIGKVTLQIPFYRPHVDPWVISISSLHLIGAPEKIQDFNDEKEKLLERERKKALLQALEEKWKNDRQQKGESYWYSVTASVVTRIVENIELKIQDVHLRFEDGVTNPSHPFAFGICIKNVSMQNAVNEPVQKLMRKKQLDVAEFSIYWDVDCTLLGDLPQMELQEAMARSMESRSHHYVLEPVFASALLKRNCSKK

SEQ ID NO: 1658 - protein, 255 aa, Homo sapiens
MFPRGAEAQDWHLDMQLTGKVVLSAAALLLVTVAYRLYKSRPAPAQRWGGNGQAEAKEEAEGSGQPAVQEASPGVLLRGPRRRRSSKRAEAPQGCSCENPRGPYVLVTGATSTDRKPQRKGSGEERGGQGSDSEQVPPCCPSQETRTAVGSNPDPPHFPRLGSEPKSSPAGLIAAADGSCAGGEPSPWQDSKPREHPGLGQLEPPHCHYVAPLQGSSDMNQSWVFTRVIGVSREEAGALEAASDVDLTLHQQEGA

SEQ ID NO: 1659 - protein, 140 aa, Homo sapiens
MSESELGRKWDRCLADAVVKIGTGFGLGIVFSLTFFKRRMWPLAFGSGMGLGMAYSNCQHDFQAPYLLHGKYVKNLLKPSAACSQPMSAGEMGVGEPSLHQSKSEVITGTMQEEAQLCGTEAGSRPFPPLPGSSLSWHQS

SEQ ID NO: 1660 - protein, 140 aa, Homo sapiens
MLQAADFIERTETAGELSRGLIGVLSSQISWCLLNVNLSKLPTRLQRLSCSVLNSSPAMRGGARGRPQLTLERPLRPGCRLHSCSEAEKGGFVRRKEIILFPPCEDPARGWLSANPGREPSPGICWHLNLGLPSLHNCEE

SEQ ID NO: 1661 - protein, 241 aa, Homo sapiens
MLRDTMKSWNDSQSDLCSTDQEEEEEMIFGENEDDLDEMMDLSDLPTSLFACSVHEAVFEAREQKERFEALFTIYDDQVTFQLFKSFRRVRINFSKPEAAARARIELHETDFNGQKLKLYFAQVQMSGEVRDKSYLLPPQPVKQFLISPPASPPVGWKQSEDAMPVINYDLLCAVSKLGPGEKYELHAGTESTPSVVVHVCESETEEEEETKNPKQKIAQTRRPDPPTAALNEPQTFDCAL

SEQ ID NO: 1662 - protein, 255 aa, Homo sapiens
MDALKSAGRALIRSPSLAKQSWGGGGRHRKLPENWTDTRETLLEGMLFSLKYLGMTLVEQPKGEELSAAAIKRIVATAKASGKKLQKVTLKVSPRGIILTDNLTNQLIENVSIYRISYCTADKMHDKVFAYIAQSQHNQSLECHAFLCTKRKMAQAVTLTVAQAFKVAFEFWQVSKEEKEKRDKASQEGGDVLGARQDCTPSLKSLVATGNLLDLEETAKAPLSTVSANTTNMDEVPRPQALSGSSVVWELDDGL

SEQ ID NO: 1663 - protein, 255 aa, Homo sapiens
MLMRKVPGFVPASPWGLRLPQKFLFLLFLSGLVTLCFGALFLLPHSSRLKRLFLAPRTQQPGLEVVAEIAGHAPAREQEPPPNPAPAAPAPGEDDPSSWASPRRRKGGLRRTRPTGPREEATAARGNSIPASRPGDEGVPFRFDFNAFRSRLRHPVLGTRADESQEPQSQVRAQREKIKEMMQFAWQSYKRYAMGKNELRPLTKDGYEGNMFGGLSGATVIDSLDTLYLMELKEEFQEAKAWVGESFHLNVSGEA

SEQ ID NO: 1664 - protein, 93 aa, Homo sapiens
MSGLRVYSTSVTGSREIKSQQSEVTRILDGKRIQYQLVDISQDNALRDEMRALAGNPKATPPQIVNGDQYCGDYELFVEAVEQNTLQEFLKLA

SEQ ID NO: 1665 - protein, 255 aa, Homo sapiens
MSWIKEGELSLWERFCANIIKAGPMPKHIAFIMDGNRRYAKKCQVERQEGHSQGFNKLAETLRWCLNLGILEVTVYAFSIENFKRSKSEVDGLMDLARQKFSRLMEEKEKLQKHGVCIRVLGDLHLLPLDLQELIAQAVQATKNYNKCFLNVCFAYTSRHEISNAVREMAWGVEQGLLDPSDISESLLDKCLYTNRSPHPDILIRTSGEVRLSDFLLWQTSHSCLVFQPVLWPEYTFWNLFEAILQFQMNHSVLQ

SEQ ID NO: 1666 - protein, 255 aa, Homo sapiens
MEPSATPGAQMGVPPGSREPSPVPPDYEDEFLRYLWRDYLYPKQYEWVLIAAYVAVFVVALVGNTLVCLAVWRNHHMRTVTNYFIVNLSLADVLVTAICLPASLLVDITESWLFGHALCKVIPYLQAVSVSVAVLTLSFIALDRWYAICHPLLFKSTARRARGSILGIWAVSLAIMVPQAAVMECSSVLPELANRTRLFSVCDERWADDLYPKIYHSCFFIVTYLAPLGLMAMAYFQIFRKLWGRQIPGTTSALV

SEQ ID NO: 1667 - protein, 200 aa, Homo sapiens
MDDKKKKRSPKPCLAQPAQAPGTLRRVPVPTSHSGSLALGLPHLPSPKQRAKFKRVGKEKCRPVLAGGGSGSAGTPLQHSFLTEVTDVYEMEGGLLNLLNDFHSGRLQAFGKECSFEQLEHVREMQEKLARLHFSLDVCGEEEDDEEEEDGVTEGLPEEQKKTMADRNLDQLLSNLEDLSNSIQKLHLAENAEPEEQSAA

SEQ ID NO: 1668 - protein, 255 aa, Homo sapiens
MGCGCSSHPEDDWMENIDVCENCHYPIVPLDGKGTLLIRNGSEVRDPLVTYEGSNPPASPLQDNLVIALHSYEPSHDGDLGFEKGEQLRILEQSGEWWKAQSLTTGQEGFIPFNFVAKANSLEPEPWFFKNLSRKDAERQLLAPGNTHGSFLIRESESTAGSFSLSVRDFDQNQGEVVKHYKIRNLDNGGFYISPRITFPGLHELVRHYTNASDGLCTRLSRPCQTQKPQKPWWEDEWEVPRETLKLVERLGAGQ

SEQ ID NO: 1669 - protein, 255 aa, Homo sapiens
MSRSSPSGKGHSRMAEPRFNNPYFWPPPPTMPSQLDNLVLINKIKEQLMAEKIRPPHLPPTSASSQQPLLVPPAPAESSQAVMSLPKLQQVPGLHPQAVPQPDVALHARPATSTVTGLGLSTRTPSVSTSESSAGAGTGTGTSTPSTPTTTSQSRLIASSPTLISGITSPPLLDSIKTIQGHGLLGPPKSERGRKKIKAENPGGPPVLVVPYPILASGETAKEGKTYRCKVCPLTFFTKSEMQIHSKSHTEAKPH

SEQ ID NO: 1670 - protein, 255 aa, Homo sapiens
MSKTNKSKSGSRSSRSRSASRSRSRSFSKSRSRSRSLSRSRKRRLSSRSRSRSYSPAHNRERNHPRVYQNRDFRGHNRGYRRPYYFRGRNRGFYPWGQYNRGGYGNYRSNWQNYRQAYSPRRGRSRSRSPKRRSPSPRSRSHSRNSDKSSSDRSRRSSSSRSSSNHSRVESSKRKSAKEKKSSSKDSRPSQAAGDNQGDEAKEQTFSGGTSQDTKASESSKPWPDATYGTGSASRASAVSELSPRERSPALKSPL

SEQ ID NO: 1671 - protein, 255 aa, Homo sapiens
MATTKRVLYVGGLAEEVDDKVLHAAFIPFGDITDIQIPLDYETEKHRGFAFVEFELAEDAAAAIDNMNESELFGRTIRVNLAKPMRIKEGSSRPVWSDDDWLKKFSGKTLEENKEEEGSEPPKAETQEGEPIAKKARSNPQVYMDIKIGNKPAGRIQMLLRSDVVPMTAENFRCLCTHEKGFGFKGSSFHRIIPQFMCQGGDFTNHNGTGGKSIYGKKFDDENFILKHTGPGLLSMANSGPNTNGSQFFLTCDKT

SEQ ID NO: 1672 - protein, 255 aa, Homo sapiens
MADMQNLVERLERAVGRLEAVSHTSDMHRGYADSPSKAGAAPYVQAFDSLLAGPVAEYLKISKEIGGDVQKHAEMVHTGLKLERALLVTASQCQQPAENKLSDLLAPISEQIKEVITFREKNRGSKLFNHLSAVSESIQALGWVAMAPKPGPYVKEMNDAAMFYTNRVLKEYKDVDKKHVDWVKAYLSIWTELQAYIKEFHTTGLAWSKTGPVAKELSGLPSGPSAGSGPPPPPPGPPPPPVSTSSGSDESASRS

SEQ ID NO: 1673 - protein, 255 aa, Homo sapiens
MKYILVTGGVISGIGKGIIASSVGTILKSCGLHVTSIKIDPYINIDAGTFSPYEHGEVFVLDDGGEVDLDLGNYERFLDIRLTKDNNLTTGKIYQYVINKERKGDYLGKTVQVVPHITDAIQEWVMRQALIPVDEDGLEPQVCVIELGGTVGDIESMPFIEAFRQFQFKVKRENFCNIHVSLVPQPSSTGEQKTKPTQNSVRELRGLGLSPDLVVCRCSNPLDTSVKEKISMFCHVEPEQVICVHDVSSIYRVPL

SEQ ID NO: 1674 - protein, 255 aa, Homo sapiens
MASERPEPEVEEAGQVFLLMKKDYRISRNVRLAWFLSHLHQTVQATPQEMLLQSEQELEVLSVLPPGWQPDEPVVPRPFLLVPSTRVTFLAWQYRFVIELDLSPSTGIVDDSTGEILFDEVFHALSRCLGGLLRPFRVPGSCIDFQPEIYVTIQAYSSIIGLQSHQVLVQGCLLDPSQREVFLQQIYEQLCLFEDKVATMLQQQYDPQSQAEDQSPDSGDLLGRKVGVSMVTADLGLVSMIRQGILALQLLPSNS

SEQ ID NO: 1675 - protein, 255 aa, Homo sapiens
MVQYELWAALPGASGVALACCFVAAAVALRWSGRRTARGAVVRARQRQRAGLENMDRAAQRFRLQNPDLDSEALLALPLPQLVQKLHSRELAPEAVLFTYVGKAWEVNKGTNCVTSYLADCETQLSQAPRQGLLYGVPVSLKECFTYKGQDSTLGLSLNEGVPAECDSVVVHVLKLQGAVPFVHTNVPQSMFSYDCSNPLFGQTVNPWKSSKSPGGSSGGEGALIGSGGSPLGLGTDIGGSIRFPSSFCGICGLK

SEQ ID NO: 1676 - protein, 255 aa, Homo sapiens
MQHYGVNGYSLHAMNSLSAMYNLHQQAAQQAQHAPDYRPSVHALTLAERLADIILEARYGSQHRKQRRSRTAFTAQQLEALEKTFQKTHYPDVVMRERLAMCTNLPEARVQVWFKNRRAKFRKKQRSLQKEQLQKQKEAEGSHGEGKAEAPTPDTQLDTEQPPRLPGSDPPAELHLSLSEQSASESAPEDQPDREEDPRAGAEDPKAEKSPGADSKGLGCKRGSPKADSPGSLTITPVAPGGGLLGPSHSYSSSP

SEQ ID NO: 1677 - protein, 255 aa, Homo sapiens
MVPSFLSLSFSSLGLWASGLILVLGFLKLIHLLLRRQTLAKAMDKFPGPPTHWLFGHALEIQETGSLDKVVSWAHQFPYAHPLWFGQFIGFLNIYEPDYAKAVYSRGDPKAPDVYDFFLQWIGRGLLVLEGPKWLQHRKLLTPGFHYDVLKPYVAVFTESTRIMLDKWEEKAREGKSFDIFCDVGHMALNTLMKCTFGRGDTGLGHRDSSYYLAVSDLTLLMQQRLVSFQYHNDFIYWLTPHGRRFLRACQVAHD

SEQ ID NO: 1678 - protein, 172 aa, Homo sapiens
METRPRLGATCLLGFSFLLLVISSDGHNGLGKGFGDHIHWRTLEDGKKEAAASGLPLMVIIHKSWCGACKALKPKFAESTEISELSHNFVMVNLEDEEEPKDEDFSPDGGYIPRILFLDPSGKVHPEIINENGNPSYKYFYVSAEQVVQGMKEAQERLTGDAFRKKHLEDEL

SEQ ID NO: 1679 - protein, 255 aa, Homo sapiens
MSYYLSSENHLDPGPIYMRENGQLHMVNLALDGVRSSLQKPRPFRLFPKGFSVELCMNREDDTARKEKTDHFIFTYTREGNLRYSAKSLFSLVLGFISDNVDHIDSLIGFPEQIAEKLFSAAEARQKFTEPGAGLRALQKFTEAYGSLVLCSLCLRNRYLVISEKLEEIKSFRELTCLDLSCCKLGDEHELLEHLTNEALSSVTQLHLKDNCLSDAGVRKMTAPVRVMKRGLENLTLLDLSCNPEITDAGIGYLF

SEQ ID NO: 1680 - protein, 1044 aa, Homo sapiens [sequence omitted]

SEQ ID NO: 1681 - protein, 210 aa, Homo sapiens
MALPQMCDGSHLASTLRYCMTVSGTVVLVAGTLCFAWWSEGDATAQPGQLAPPTEYPVPEGPSPLLRSVSFVCCGAGGLLLLIGLLWSVKASIPGPPRWDPYHLSRDLYYLTVESSEKESCRTPKVVDIPTYEEAVSFPVAEGPPTPPAYPTEEALEPSGSRDALLSTQPAWPPPSYESISLALDAVSAETTPSATRSCSGLVQTARGGS

SEQ ID NO: 1682 - protein, 255 aa, Homo sapiens
MRAVRRGLREGGAMAAARDPPEVSLREATQRKLRRFSELRGKLVARGEFWDIVAITAADEKQELAYNQQLSEKLKRKELPLGVQYHVFVDPAGAKIGNGGSTLCALQCLEKLYGDKWNSFTILLIHSGGYSQRLPNASALGKIFTALPLGNPIYQMLELKLAMYIDFPLNMNPGILVTCADDIELYSIGEFEFIRFDKPGFTALAHPSSLTIGTTHGVFVLDPFDDLKHRDLEYRSCHRFLHKPSIEKMYQFNAV

SEQ ID NO: 1683 - protein, 255 aa, Homo sapiens
MAAGFGRCCRVLRSISRFHWRSQHTKANRQREPGLGFSFEFTEQQKEFQATARKFAREEIIPVAAEYDKTGEYPVPLIRRAWELGLMNTHIPENCGGLGLGTFDACLISEELAYGCTGVQTAIEGNSLGQMPIIIAGNDQQKKKYLGRMTEEPLMCAYCVTEPGAGSDVAGIKTKAEKKGDEYIINGQKMWITNGGKANWYFLLARSDPDPKAPANKAFTGFIVEADTPGIQIGRKELNMGQRCSDTRGIVFEDV

SEQ ID NO: 1684 - protein, 255 aa, Homo sapiens
MSRPQLRRWRLVSSPPSGVPGLALLALLALLALRLAAGTDCPCPEPELCRPIRHHPDFEVFVFDVGQKTWKSYDWSQITTVATFGKYDSELMCYAHSKGARVVLKGDVSLKDIIDPAFRASWIAQKLNLAKTQYMDGINIDIEQEVNCLSPEYDALTALVKETTDSFHREIEGSQVTFDVAWSPKNIDRRCYNYTGIADACDFLFVMSYDEQSQIWSECIAAANAPYNQTLTGYNDYIKMSINPKKLVMGVPWYG

SEQ ID NO: 1685 - protein, 255 aa, Homo sapiens
MARLRDCLPRLMLTLRSLLFWSLVYCYCGLCASIHLLKLLWSLGKGPAQTFRRPAREHPPACLSDPSLGTHCYVRIKDSGLRFHYVAAGERGKPLMLLLHGFPEFWYSWRYQLREFKSEYRVVALDLRGYGETDAPIHRQNYKLDCLITDIKDILDSLGYSKCVLIGHDWGGMIAWLIAICYPEMVMKLIVINFPHPNVFTEYILRHPAQLLKSSYYYFFQIPWFPEFMFSINDFKVLKHLFTSHSTGIGRKGCQ

SEQ ID NO: 1686 - protein, 255 aa, Homo sapiens
MADFAGPSSAGRKAGAPRCSRKAAGTKQTSTLKQEDASKRKAELEAAVRKKIEFERKALHIVEQLLEENITEEFLMECGRFITPAHYSDVVDERSIVKLCGYPLCQKKLGIVPKQKYKISTKTNKVYDITERKSFCSNFCYQASKFFEAQIPKTPVWVREEERHPDFQLLKEEQSGHSGEEVQLCSKAIKTSDIDNPSHFEKQYESSSSSTHSDSSSDNEQDFVSSILPGNRPNSTNIRPQLHQKSIMKKKAGHK

SEQ ID NO: 1687 - protein, 162 aa, Homo sapiens
MARSLCPGAWLRKPYYLQARFSYVRMKYLFFSWLVVFVGSWIIYVQYSTYTELCRGKDCKKIICDKYKTGVIDGPACNSLCVTETLYFGKCLSTKPNNQMYLGIWDNLPGVVKCQMEQALHLDFGTELEPRKEIVLFDKPTRGTTVQKFKEMVYSLFKDQHR

SEQ ID NO: 1688 - protein, 255 aa, Homo sapiens
MAGPRVEVDGSIMEGGGQILRVSTALSCLLGLPLRVQKIRAGRSTPGLSSGGWKSKIKVLTRPQHLSGLEMIRDLCDGQLEGAEIGSTEITFTPEKIKGGIHTADTKTAGSVCLLMQVSMPCVLFAASPSELHLKGGTNAEMAPQIDYTVMVFKPIVEKFGFIFNCDIKTRGYYPKGGGEVIVRMSPVKQLNPINLTERGCVTKIYGRAFVAGVLPFKVAKDMAAAAVRCIRKEIRDLYVNIQPVQEPKDQAFGN

SEQ ID NO: 1689 - protein, 255 aa, Homo sapiens
MLPLSIKDDEYKPPKFNLFGKISGWFRSILSDKTSRNLFFFLCLNLSFAFVELLYGIWSNCLGLISDSFHMFFDSTAILAGLAASVISKWRDNDAFSYGYVRAEVLAGFVNGLFLIFTAFFIFSEGVERALAPPDVHHERLLLVSILGFVVNLIGIFVFKHGGHGHSHGSGHGHSHSLFNGALDQAHGHVDHCHSHEVKHGAAHSHDHAHGHGHFHSHDGPSLKETTGPSRQILQGVFLHILADTLGSIGVIASA

SEQ ID NO: 1690 - protein, 255 aa, Homo sapiens
MAAPEQPLAISRGCTSSSSLSPPRGDRTLLVRHLPAELTAEEKEDLLKYFGAQSVRVLSDKGRLKHTAFATFPNEKAAIKALTRLHQLKLLGHTLVVEFAKEQDRVHSPCPTSGSEKKKRSDDPVEDDKEKKELGYLTVENGIAPNHGLTFPLNSCLKYMYPPPSSTILANIVNALASVPKFYVQVLHLMNKMNLPTPFGPITARPPMYEDYMPLHAPLPPTSPQPPEEPPLPDEDEELSSEESEYESTDDEDRQ

SEQ ID NO: 1691 - protein, 255 aa, Homo sapiens
MRSPATGVPLPTPPPPLLLLLLLLLPPPLLGDQVGPCRSLGSRGRGSSGACAPMGWLCPSSASNLWLYTSRCRDAGTELTGHLVPHHDGLRVWCPESEAHIPLPPAPEGCPWSCRLLGIGGHLSPQGKLTLPEEHPCLKAPRLRCQSCKLAQAPGLRAGERSPEESLGGRRKRNVNTAPQFQPPSYQATVPENQPAGTPVASLRAIDPDEGEAGRLEYTMDALFDSRSNQFFSLDPVTGAVTTAEELDRETKSTH

SEQ ID NO: 1692 - protein, 255 aa, Homo sapiens
MQEFTKFPTKTGRRSLSRSISQSSTDSYSSAASYTDSSDDEVSPREKQQTNSKGSSNFCVKNIKQAEFGRREIEIAEQDMSALISLRKRAQGEKPLAGAKIVGCTHITAQTAVLIETLCALGAQCRWSACNIYSTQNEVAAALAEAGVAVFAWKGESEDDFWWCIDRCVNMDGWQANMILDDGGDLTHWVYKKYPNVFKKIRGIVEESVTGVHRLYQLSKAGKLCVPAMNVNDSVTKQKFDNLYCCRESILDGLK

SEQ ID NO: 1693 - protein, 255 aa, Homo sapiens
MSGHRSTRKRCGDSHPESPVGFGHMSTTGCVLNKLFQLPTPPLSRHQLKRLEEHRYQSAGRSLLEPLMQGYWEWLVRRVPSWIAPNLITIIGLSINICTTILLVFYCPTATEQAPLWAYIACACGLFIYQSLDAIDGKQARRTNSSSPLGELFDHGCDSLSTVFVVLGTCIAVQLGTNPDWMFFCCFAGTFMFYCAHWQTYVSGTLRFGIIDVTEVQIFIIIMHLLAVIGGPPFWQSMIPVLNIQMKIFPALCTV

SEQ ID NO: 1694 - protein, 255 aa, Homo sapiens
MTKLILLTGLVLILNLQLGSAYQLTCYFTNWAQYRPGLGRFMPDNIDPCLCTHLIYAFAGRQNNEITTIEWNDVTLYQAFNGLKNKNSQLKTLLAIGGWNFGTAPFTAMVSTPENRQTFITSVIKFLRQYEFDGLDFDWEYPGSRGSPPQDKHLFTVLVQEMREAFEQEAKQINKPRLMVTAAVAAGISNIQSGYEIPQLSQYLDYIHVMTYDLHGSWEGYTGENSPLYKYPTDTGSNAYLNVDYVMNYWKDNGA

SEQ ID NO: 1695 - protein, 255 aa, Homo sapiens
METMRAQRLQPGVGTSGRGTLRALRPGVTGAAAATATPPAGPPPAPPPPAPPPPPLLLSGAPGLPLPPGAAGSPAVLREAVEAVVRSFAKHTQGYGRVNVVEALQEFWQMKQSRGADLKNGALVVYEMVPSNSPPYVCYVTLPGGSCFGSFQFCPTKAEARRSAAKIALMNSVFNEHPSRRITDEFIEKSVSEALASFNGNREEADNPNTGIGAFRFMLESNKGKSMLEFQELMTVFQLLHWNGSLKAMRERQCS

SEQ ID NO: 1696 - protein, 169 aa, Homo sapiens
MVSSKGLWKERPSAHTSECFSTTACPVAFILLVWNSQTPAGLQSLCTGRHPSLSARAQRAGPRASREEGTFWTERVGQERWLIRSGSSQNESQEDQGAGLISQAGLKADNRRESSTWANEVEDRRPQCTPALNLTPSHPHPPHSLTTFLRSVIGIQIPPGLVAAGGTVA

SEQ ID NO: 1697 - protein, 87 aa, Homo sapiens
MAKHLKFIARTVMVQEGNVESAYRTLNRILTMDGLIEDIKHRRYYEKPCRRRQRESYERCRRIYNMEMARKINFLMRKNRADPWQGC

SEQ ID NO: 1698 - protein, 184 aa, Homo sapiens
MESFSSKSLALQAEKKLLSKMAGRSVAHLFIDETSSEVLDELYRVSKEYTHSRPQAQRVIKDLIKVAIKVAVLHRNGSFGPSELALATRFRQKLRQGAMTALSFGEVDFTFEAAVLAGLLTECRDVLLELVEHHLTPKSHGRIRHVFDHFSDPGLLTALYGPDFTQHLGKICDGLRKLLDEGKL

SEQ ID NO: 1699 - protein, 116 aa, Homo sapiens
MCDQTKHSKCCPAKGNQCCPPQQNQCCQSKGNQCCPPKQNQCCQPKGSQCCPPKHNHCCQPKPPCCIQARCCGLETKPEVSPLNMESEPNSPQTQDKGCQTQQQPHSPQNESRPSK

SEQ ID NO: 1700 - protein, 255 aa, Homo sapiens
MDIKHHQNGTRGQRRKQPHTTVQRLLTWGLPVSCSWFLWRQPGEFPVTALLLGAGAGGLLAIGLFQLLVNPMNIYEEQKIMFLYSLVGLGAMGWGTSPHIRCASLLLVPKMLGKEGRLFVLGYALAAIYVGPVANLRHNLNNVIASLGCTVELQINNTRAAWRISTAPLRAMFKDLLSSKELLRAETRNISATFEDLDAQVNSETGYTPEDTMDSGETAQGREARQAPASRLHLSTQKMYELKTKLRCSYVVNQA

SEQ ID NO: 1701 - protein, 221 aa, Homo sapiens
MEAGGFLDSLIYGACVVFTLGMFSAGLSDLRHMRMTRSVDNVQFLPFLTTEVNNLGWLSYGALKGDGILIVVNTVGAALQTLYILAYLHYCPRKRVVLLQTATLLGVLLLGYGYFWLLVPNPEARLQQLGLFCSVFTISMYLSPLADLAKVIQTKSTQCLSYPLTIATLLTSASWCLYGFRLRDPYIMVSNFPGIVTSFIRFWLFWKYPQEQDRNYWLLQT

SEQ ID NO: 1702 - protein, 125 aa, Homo sapiens
MERHTSHPNRKVPAKEEANAVPLCRAKPSPSYINLQASSPPATFLNIQTTKLPSVDHKPKECLGLLECMYANLQLQTQLAQQQMAVLEHLQASVTQLAPGRGSNNSSLPALSPNPLLNHLPQFSK

SEQ ID NO: 1703 - protein, 255 aa, Homo sapiens
MPGWLTLPTLCRFLLWAFTIFHKAQGDPASHPGPHYLLPPIHEVIHSHRGATATLPCVLGTTPPSYKVRWSKVEPGELRETLILITNGLHARGYGPLGGRARMRRGHRLDASLVIAGVRLEDEGRYRCELINGIEDESVALTLSLEGVVFPYQPSRGRYQFNYYEAKQACEEQDGRLATYSQLYQAWTEGLDWCNAGWLLEGSVRYPVLTARAPCGGRGRPGIRSYGPRDRMRDRYDAFCFTSALAGQVFFVPGR

SEQ ID NO: 1704 - protein, 255 aa, Homo sapiens
MLRGGRRGQLGWHSWAAGPGSLLAWLILASAGAAPCPDACCPHGSSGLRCTRDGALDSLHHLPGAENLTELYIENQQHLQHLELRDLRGLGELRNLTIVKSGLRFVAPDAFHFTPRLSRLNLSFNALESLSWKTVQGLSLQELVLSGNPLHCSCALRWLQRWEEEGLGGVPEQKLQCHGQGPLAHMPNASCGVPTLKVQVPNASVDVGDDVLLRCQVEGRGLEQAGWILTELEQSATVMKSGGLPSLGLTLANVT

SEQ ID NO: 1705 - protein, 255 aa, Homo sapiens
MLLLFLLFEGLCCPGENTAAPQALQSYHLAAEEQLSFRMLQTSSFANHSWAHSEGSGWLGDLQTHGWDTVLGTIRFLKPWSHGNFSKQELKNLQSLFQLYFHSFIQIVQASAGQFQLEYPFEIQILAGCRMNAPQIFLNMAYQGSDFLSFQGISWEPSPGAGIRAQNICKVLNRYLDIKEILQSLLGHTCPRFLAGLMEAGESELKRKVKPEAWLSCGPSPGPGRLQLVCHVSGFYPKPVWVMWMRGEQEQRGTQ

SEQ ID NO: 1706 - protein, 255 aa, Homo sapiens
MGNTLGLAPMGTLPRRSPRREEPLPNPGSFDELHRLCKDVFPAQMEGVKLVVNKVLSSHFQVAHTIHMSALGLPGYHLHAAYAGDWQLSPTEVFPTVVGDMDSSGSLNAQVLLLLAERLRAKAVFQTQQAKFLTWQFDGEYRGDDYTATLTLGNPDLIGESVIMVAHFLQSLTHRLVLGGELVYHRRPGEEGAILTLAGKYSAVHWVATLNVGSGGAHASYYHRANEQVQVGVEFEANTRLQDTTFSFGYHLTLP

SEQ ID NO: 1707 - protein, 255 aa, Homo sapiens
MLDCSDYVLDSRMNNPSETSKPSMESGDGNTGTQTNGLDFQKQPVPVGGAISTAQAQAFLGHLHQVQLAGTSLQAAAQSLNVQSKSNEESGDSQQPSQPSQQPSVQAAIPQTQLMLAGGQITGLTLTPAQQQLLLQQAQAQAQLLAAAVQQHSASQQHSAAGATISASAATPMTQIPLSQPIQIAQDLQQLQQLQQQNLNLQQFVLVHPTTNLQPAQFIISQTPQGQQGLLQAQNLLTQLPQQSQANLLQSQPSI

SEQ ID NO: 1708 - protein, 255 aa, Homo sapiens
MMIHGFQSSHRDFCFGPWKLTASKTHIMKSADVEKLADELHMPSLPEMMFGDNVLRIQHGSGFGIEFNATDALRCVNNYQGMLKVACAEEWQESRTEGEHSKEVIKPYDWTYTTDYKGTLLGESLKLKVVPTTDHIDTEKLKAREQIKFFEEVLLFEDELHDHGVSSLSVKIRVMPSSFFLLLRFFLRIDGVLIRMNDTRLYHEADKTYMLREYTSRESKISSLMHVPPSLFTEPNEISQYLPIKEAVCEKLIFP

SEQ ID NO: 1709 - protein, 160 aa, Homo sapiens
MDKLKKVLSGQDTEDRSGLSEVVEASSLSWSTRIKGFIACFAIGILCSLLGTVLLWVPRKGLHLFAVFYTFGNIASIGSTIFLMGPVKQLKRMFEPTRLIATIMVLLCFALTLCSAFWWHNKGLALIFCILQSLALTWYSLSFIPFARDAVKKCFAVCLA

SEQ ID NO: 1710 - protein, 255 aa, Homo sapiens
MARFGEAVVARPGSGDGDSDQSRNRQGTPVPASGQAAAYKQTKAQRARTMALYNPIPVRQNCFTVNRSLFIFGEDNIVRKYAKKLIDWPPFEYMILATIIANCIVLALEQHLPEDDKTPMSRRLEKTEPYFIGIFCFEAGIKIVALGFIFHKGSYLRNGWNVMDFIVVLSGILATAGTHFNTHVDLRTLRAVRVLRPLKLVSGIPSLQIVLKSIMKAMVPLLQIGLLLFFAILMFAIIGLEFYSGKLHRACFMNN

SEQ ID NO: 1711 - protein, 255 aa, Homo sapiens
MLVTDLEYALDKKVEQDLWNHAFKNQITTLQGQAKNRANPNRSEVQANLSLFLEAASGFYTQLLQELCTVFNVDLPCRVKSSQLGIISNKQTHTSAIVKPQSSSCSYICQHCLVHLGDIARYRNQTSQAESYYRHAAQLVPSNGQPYNQLAILASSKGDHLTTIFYYCRSIAVKFPFPAASTNLQKALSKALESRDEVKTKWGVSDFIKAFIKFHGHVYLSKSLEKLSPLREKLEEQFKRLLFQKAFNSQQLVHV

SEQ ID NO: 1712 - protein, 44 aa, Homo sapiens
MGMYPPLLLKIYLSRHISILFYLKILYKSGIIWLSWYSFILLVL

SEQ ID NO: 1713 - protein, 211 aa, Homo sapiens
MQSAMFLAVQHDCRPMDKSAGSGHKSEEKREKMKRTLLKDWKTRLSYFLQNSSTPGKPKTGKKSKQQAFIKPSPEEAQLWSEAFDELLASKYGLAAFRAFLKSEFCEENIEFWLACEDFKKTKSPQKLSSKARKIYTDFIEKEAPKEINIDFQTKTLIAQNIQEATSGCFTTAQKRVYSLMENNSYPRFLESEFYQDLCKKPQITTEPHAT

SEQ ID NO: 1714 - protein, 255 aa, Homo sapiens
MSVCTLSVPVSSLSPGRRCNTFSDSGILGCVPINSNTDEEDVVEEKMVAEGVNKEAKQPAKKKRKKGLRIKGKRRRKKLILAKKFSKDLGSGRPVADAPALLASNDPEQDEESLFESNIEKQIYLPSTRAKTSIVWHFFHVDPQYTWRAICNLCEKSVSRGKPGSHLGTSTLQRHLQARHSPHWTRANKFGVASGEEDFTLDVSLSPSSGSNGSFEYIPTDPLDDNRMGKKHDKSASDALRAERGRFLIKSNIVK

SEQ ID NO: 1715 - protein, 255 aa, Homo sapiens
MGCDGRVSGLLRRNLQPTLTYWSVFFSFGLCIAFLGPTLLDLRCQTHSSLPQISWVFFSQQLCLLLGSALGGVFKRTLAQSLWALFTSSLAISLVFAVIPFCRDVKVLASVMALAGLAMGCIDTVANMQLVRMYQKDSAVFLQVLHFFVGFGALLSPLIADPFLSEANCLPANSTANTTSRGHLFHVSRVLGQHHVDAKPWSNQTFPGLTPKDGAGTRVSYAFWIMALINLPVPMAVLMLLSKERLLTCCPQRRP

SEQ ID NO: 1716 - protein, 176 aa, Homo sapiens
MKASSLAFSLLSAAFYLLWTPSTGLKTLNLGSCVIATNLQEIRNGFSEIRGSVQAKDGNIDIRILRRTESLQDTKPANRCCLLRHLLRLYLDRVFKNYQTPDHYTLRKISSLANSFLTIKKDLRLCHAHMTCHCGEEAMKKYSQILSHFEKLEPQAAVVKALGELDILLQWMEETE

SEQ ID NO: 1717 - protein, 255 aa, Homo sapiens
MTSYRERSADLARFYTVTEPQRHPRGYTVYKVTARIIVWKRYSDFKKLHKELWQIHKNLFRHSELFPPFAKGIVFGRFDETVIEERRQCAEDLLQFSANIPALYNSKQLEDFFKGGIINDSSELIGPAEAHSDSLIDTFPECSTEGFSSDSDLVSLTVDVDSLAELDDGMASNQNSPIRTFGLNLSSDSSALGAVASDSEQSKTEEERESRSLFPGSLKPKLGKRDYLEKAGELIKLALKKEEEDDYEAASDFYR

SEQ ID NO: 1718 - protein, 141 aa, Homo sapiens
MEPSHKDAETAAAAAAVAAADPRGASSSSGVVVQVREKKGPLRAAIPYMPFPVAVICLFLNTFVPGLGTFVSAFTVLCGARTDLPDRHVCCVFWLNIAAALIQILTAIVMVGWIMSIFWGMDMVILAISQGYKEQGIPQQL

SEQ ID NO: 1719 - protein, 181 aa, Homo sapiens
MGNIFANLFKGLFGKKEMRILMVGLDAAGKTTILYKLKLGEIVTTIPTIGFNVETVEYKNISFTVWDVGGQDKIRPLWRHYFQNTQGLIFVVDSNDRERVNEAREELMRMLAEDELRDAVLLVFANKQDLPNAMNAAEITDKLGLHSLRHRNWYIQATCATSGDGLYEGLDWLSNQLRNQK

SEQ ID NO: 1720 - protein, 255 aa, Homo sapiens
MRRRSRMLLCFAFLWVLGIAYYMYSGGGSALAGGAGGGAGRKEDWNEIDPIKKKDLHHSNGEEKAQSMETLPPGKVRWPDFNQEAYVGGTMVRSGQDPYARNKFNQVESDKLRMDRAIPDTRHDQCQRKQWRVDLPATSVVITFHNEARSALLRTVVSVLKKSPPHLIKEIILVDDYSNDPEDGALLGKIEKVRVLRNDRREGLMRSRVRGADAAQAKVLTFLDSHCECNEHWLEPLLERVAEDRTRVVSPIIDV

SEQ ID NO: 1721 - protein, 255 aa, Homo sapiens
MCVGARRLGRGPCAALLLLGLGLSTVTGLHCVGDTYPSNDRCCHECRPGNGMVSRCSRSQNTVCRPCGPGFYNDVVSSKPCKPCTWCNLRSGSERKQLCTATQDTVCRCRAGTQPLDSYKPGVDCAPCPPGHFSPGDNQACKPWTNCTLAGKHTLQPASNSSDAICEDRDPPATQPQETQGPPARPITVQPTEAWPRTSQGPSTRPVEVPGGRAVAAILGLGLVLGLLGPLAILLALYLLRRDQRLPPDAHKPPG

SEQ ID NO: 1722 - protein, 255 aa, Homo sapiens
MEMEQEKMTMNKELSPDAAAYCCSACHGDETWSYNHPIRGRAKSRSLSASPALGSTKEFRRTRSLHGPCPVTTFGPKACVLQNPQTIIATPLSLASQLLPSPAVSHSGQGGVTGQVHVLPQPSDQGVLSGPRAARGQTAPQEEAVTQEEVEALVCGHTQRWVPGPVYDAAAGGSGWAQLSLRAGMGVGQATGHIQDPASQRLTWNKSPKSVLVIKKMRDASLLQPFKELCTHLMEARGAGGKGAWGAHGVGGASI

SEQ ID NO: 1723 - protein, 217 aa, Homo sapiens
MTLLPRLALREEEARRGPLRAPVQPGLGERSPQRHREPKQGRVSQRWHPAREPLAATGFLHGLGHLGRAAQSPRASCCILWPGTWGDPLRTLGRSQREVQTVCTGVSGDQAQKEQDGHLLAWRKILLPGKKTTPRGIGLGCRTLSQATAPFLLQNWGRKRAFRPGSENPSSGTSRPSRGRLEARSSGLDEAWEAQRLTGHGRFPSPRKEKSLQRGLG

SEQ ID NO: 1724 - protein, 255 aa, Homo sapiens
MSDERRLPGSAVGWLVCGGLSLLANAWGILSVGAKQKKWKPLEFLLCTLAATHMLNVAVPIATYSVVQLRRQRPDFEWNEGLCKVFVSTFYTLTLATCFSVTSLSYHRMWMVCWPVNYRLSNAKKQAVHTVMGIWMVSFILSALPAVGWHDTSERFYTHGCRFIVAEIGLGFGVCFLLLVGGSVAMGVICTAIALFQTLAVQVGRQADRRAFTVPTIVVEDAQGKRRSSIDGSEPAKTSLQTTGLVTTIVFIYDC

SEQ ID NO: 1725 - protein, 255 aa, Homo sapiens
MTADKDKDKDKEKDRDRDRDREREKRDKARESENSRPRRSCTLEGGAKNYAESDHSEDEDNDNNSATAEESTKKNKKKPPKKKSRYERTDTGEITSYITEDDVVYRPGDCVYIESRRPNTPYFICSIQDFKLVHNSQACCRSPTPALCDPPACSLPVASQPPQHLSEAGRGPVGSKRDHLLMNVKWYYRQSEVPDSVYQHLVQDRHNENDSGRELVITDPVIKNRELFISDYVDTYHAAALRGKCNISHFSDIFA

SEQ ID NO: 1726 - protein, 255 aa, Homo sapiens
MENKEAGTPPPIPSREGRLQPTLLLATLSAAFGSAFQYGYNLSVVNTPHKVFKSFYNETYFERHATFMDGKLMLLLWSCTVSMFPLGGLLGSLLVGLLVDSCGRKGTLLINNIFAIIPAILMGVSKVAKAFELIVFSRVVLGVCAGISYSALPMYLGELAPKNLRGMVGTMTEVFVIVGVFLAQIFSLQAILGNPAGWPVLLALTGVPALLQLLTLPFFPESPRYSLIQKGDEATARQALRRLRGHTDMEAELED

SEQ ID NO: 1727 - protein, 255 aa, Homo sapiens
MAAVVALSLRRRLPATTLGGACLQASRGAQTAAATAPRIKKFAIYRWDPDKAGDKPHMQTYEVDLNKCGPMVLDALIKIKNEVDSTLTFRRSCREGICGSCAMNINGGNTLACTRRIDTNLNKVSKIYPLPHMYVIKDLVPDLSNFYAQYKSIEPYLKKKDESQEGKQQYLQSIEEREKLDGLYECILCACCSTSCPSYWWNGDKYLGPAVLMQAYRWMIDSRDDFTEERLAKLQDPFSLYRCHTIMNCTRTCPK

SEQ ID NO: 1728 - protein, 227 aa, Homo sapiens
MACTKTLQQSQPISAGATTTTTAVAPAGGHSGSTECDLECLVCREPYSCPRLPKLLACQHAFCAICLKLLLCVQDNTWSITCPLCRKVTAVPGGLICSLRDHEAVVGQLAQPCTEVSLCPQGLVDPADLAAGHPSLVGEDGQDEVSANHVAARRLAAHLLLLALLIILIGPFIYPGVLRWVLTFIIALALLMSTLFCCLPSTRGSCWPSSRTLFCREQKHSHISSIA

SEQ ID NO: 1729 - protein, 255 aa, Homo sapiens
MGYFRCAGAGSFGRRRKMEPSTAARAWALFWLLLPLLGAVCASGPRTLVLLDNLNVRETHSLFFRSLKDRGFELTFKTADDPSLSLIKYGEFLYDNLIIFSPSVEDFGGNINVETISAFIDGGGSVLVAASSDIGDPLRELGSECGIEFDEEKTAVIDHHNYDISDLGQHTLIVADTENLLKAPTIVGKSSLNPILFRGVGMVADPDNPLVLDILTGSSTSYSFFPDKPITQYPHAVGKNTLLIAGLQARNNARV

SEQ ID NO: 1730 - protein, 255 aa, Homo sapiens
MAGAAPTTAFGQAVIGPPGSGKTTYCLGMSEFLRALGRRVAVVNLDPANEGLPYECAVDVGELVGLGDVMDALRLGPNGGLLYCMEYLEANLDWLRAKLDPLRGHYFLFDCPGQVELCTHHGALRSIFSQMAQWDLRLTAVHLVDSHYCTDPAKFISVLCTSLATMLHVELPHINLLSKMDLIEHYGKLAFNLDYYTEVLDLSYLLDHLASDPFFRHYRQLNEKLVQLIEDYSLVSFIPLNIQDKESIQRVLQAV

SEQ ID NO: 1731 - protein, 255 aa, Homo sapiens
MWNSGFESYGSSSYGGAGGYTQSPGGFGSPAPSQAEKKSRARAQHIVPCTISQLLSATLVDEVFRIGNVEISQVTIVGIIRHAEKAPTNIVYKIDDMTAAPMDVRQWVDTDDTSSENTVVPPETYVKVAGHLRSFQNKKSLVAFKIMPLEDMNEFTTHILEVINAHMVLSKANSQPSAGRAPISNPGMSEAGNFGGNSFMPANGLTVAQNQVLNLIKACPRPEGLNFQDLKNQLKHMSVSSIKQAVDFLSNEGHI

SEQ ID NO: 1732 - protein, 255 aa, Homo sapiens
MASYPYRQGCPGAAGQAPGAPPGSYYPGPPNSGGQYGSGLPPGGGYGGPAPGGPYGPPAGGGPYGHPNPGMFPSGTPGGPYGGAAPGGPYGQPPPSSYGAQQPGLYGQGGAPPNVDPEAYSWFQSVDSDHSGYISMKELKQALVNCNWSSFNDETCLMMINMFDKTKSGRIDVYGFSALWKFIQQWKNLFQQYDRDRSGSISYTELQQALSQMGYNLSPQFTQLLVSRYCPRSANPAMQLDRFIQVCTQLQVLTE

SEQ ID NO: 1733 - protein, 167 aa, Homo sapiens
MNRPAPVEISYENMRFLITHNPTNATLNKFTEELKKYGVTTLVRVCDATYDKAPVEKEGIHVLDWPFDDGAPPPNQIVDDWLNLLKTKFREEPGCCVAVHCVAGLGRAPVLVALALIECGMKYEDAVQFIRQKRRGAFNSKQLLYLEKYRPKMRLRFRDTNGHCCVQ

SEQ ID NO: 1734 - protein, 255 aa, Homo sapiens
MACSLKDELLCSICLSIYQDPVSLGCEHYFCRRCITEHWVRQEAQGARDCPECRRTFAEPALAPSLKLANIVERYSSFPLDAILNARRAARPCQAHDKVKLFCLTDRALLCFFCDEPALHEQHQVTGIDDAFDELQRELKDQLQALQDSEREHTEALQLLKRQLAETKSSTKSLRTTIGEAFERLHRLLRERQKAMLEELEADTARTLTDIEQKVQRYSQQLRKVQEGAQILQERLAETDRHTFLAGVASLSERL

SEQ ID NO: 1735 - protein, 255 aa, Homo sapiens
MENELPVPHTSSSACATSSTSGASSSSGCNNSSSGGSGRPTGPQISVYSGIPDRQTVQVIQQALHRQPSTAAQYLQQMYAAQQQHLMLQTAALQQQHLSSAQLQSLAAVQQASLVSNRQGSTSGSNVSAQAPAQSSSINLAASPAAAQLLNRAQSVNSAAASGIAQQAVLLGNTSSPALTASQAQMYLRAQMLIFTPTATVATVQPELGTGSPARPPTPAQVQNLTLRTQQTPAAAASGPTPTQPVLPSLALKPT

SEQ ID NO: 1736 - protein, 123 aa, Homo sapiens
MAVSHSVKERTISENSLIILLQGLQGRVTTVDLRDESVAHGRIDNVDAFMNIRLAKVTYTDRWGHQVKLDDLFVTGRNVRYVHIPDDVNITSTIEQQLQIIHRVRNFGGKGQGRWEFPPKNCK

SEQ ID NO: 1737 - protein, 255 aa, Homo sapiens
MLRVAWRTLSLIRTRAVTQVLVPGLPGGGSAKFPFNQWGLQPRSLLLQAARGYVVRKPAQSRLDDDPPPSTLLKDYQNVPGIEKVDDVVKRLLSLEMANKKEMLKIKQEQFMKKIVANPEDTRSLEARIIALSVKIRSYEEHLEKHRKDKAHKRYLLMSIDQRKKMLKNLRNTNYDVFEKICWGLGIEYTFPPLYYRRAHRRFVTKKALCIRVFQETQKLKKRRRALKAAAAAQKQAKRRNPDSPAKAIPKTLKD

SEQ ID NO: 1738 - protein, 255 aa, Homo sapiens
MSLQYGAEETPLAGSYGAADSFPKDFGYGVEEEEEEAAAAGGGVGAGAGGGCGPGGADSSKPRILLMGLRRSGKSSIQKVVFHKMSPNETLFLESTNKIYKDDISNSSFVNFQIWDFPGQMDFFDPTFDYEMIFRGTGALIYVIDAQDDYMEALTRLHITVSKAYKVNPDMNFEVFIHKVDGLSDDHKIETQRDIHQRANDDLADAGLEKLHLSFYLTSIYDHSIFEAFSKVVQKLIPQLPTLENLLNIFISNSG

SEQ ID NO: 1739 - protein, 255 aa, Homo sapiens
MAAATASPRSLLVLLQVVVLALAQIRGPPGERGPPGPPGPPGVPGSDGIDGDNGPPGKAGPPGPKGEPGKAGPDGPDGKPGIDGLTGAKGEPGPMGIPGVKGQPGLPGPPGLPGPGFAGPPGPPGPVGLPGEIGIRGPKGDPGPDGPSGPPGPPGKPGRPGTIQGLEGSADFLCPTNCPPGMKGPPGLQGVKGHAGKRGILGDPGHQGKPGPKGDVGASGEQGIPGPPGPQGIRGYPGMAGPKGETGPHGYKGMV

SEQ ID NO: 1740 - protein, 255 aa, Homo sapiens
MDRSKRNSIAGFPPRVERLEEFEGGGGGEGNVSQVGRVWPSSYRALISAFSRLTRLDDFTCEKIGSGFFSEVFKVRHRASGQVMALKMNTLSSNRANMLKEVQLMNRLSHPNILRFMGVCVHQGQLHALTEYINSGNLEQLLDSNLHLPWTVRVKLAYDIAVGLSYLHFKGIFHRDLTSKNCLIKRDENGYSAVVADFGLAEKIPDVSMGSEKLAVVGSPFWMAPEVLRDEPYNEKADVFSYGIILCEIIARIQA

SEQ ID NO: 1741 - protein, 255 aa, Homo sapiens
MLRRVTVAAVCATRRKLCEAGRELAALWGIETRGRCEDSAAARPFPILAMPGRNKAKSTCSCPDLQPNGQDLGENSRVARLGADESEEEGRRGSLSNAGDPEIVKSPSDPKQYRYIKLQNGLQALLISDLSNMEGKTGNTTDDEEEEEVEEEEEDDDEDSGAEIEDDDEEGFDDEDEFDDEHDDDLDTEDNELEELEERAEARKKTTEKQQLQSLFLLWSKLTDRLWFKSTYSKMSSTLLVETRNLYGVVGAESR

SEQ ID NO: 1742 - protein, 354 aa, Homo sapiens
MPLVVFCGLPYSGKSRRAEELRVALAAEGRAVYVVDDAAVLGAEDPAVYGDSAREKALRGALRASVERRLSRHDVVILDSLNYIKGFRYELYCLARAARTPLCLVYCVRPGGPIAGPQVAGANENPGRNVSVSWRPRAEEDGRAQAAGSSVLRELHTADSVVNGSAQADVPKELEREESGAAESPALVTPDSEKSAKHGSGAFYSPELLEALTLRFEAPDSRNRWDRPLFTLVGLEEPLPLAGIRSALFENRAPPPHQSTQSQPLASGSFLHQLDQVTSQVLAGLMEAQKSAVPGDLLTLPGTTEHLRFTRPLTMAELSRLRRQFISYTKMHPNNENLPQLANMFLQYLSQSLH

SEQ ID NO: 1743 - protein, 255 aa, Homo sapiens
MMPGPRPRKGPQARGQGVAAAKQMGLFMEFGPEDMLLGMDEAEDDEDLEAELLALTGEAQTTGKKPAPKGQAPLPMAHIEKLAADCMRDVEEEEEEEGLEEDAELLTELQEVLGVDEETEPLDGDEVADPGGSEEENGLEDTEPPVQTAVLTASAPAAQAGASQGLHALLEERIHNYREAAASAKEAGEAAKARRCERGLKTLESQLASVRRGRKINEDEIPPPVALGKRPLAPQEPANRSPETDPPAPPALESD

SEQ ID NO: 1744 - protein, 306 aa, Homo sapiens
MAAVDDLQFEEFGNAATSLTANPDATTVNIEDPGETPKHQPGSPRGSGREEDDELLGNDDSDKTELLAGQKKSSPFWTFEYYQTFFDVDTYQVFDRIKGSLLPIPGKNFVRLYIRSNPDLYGPFWICATLVFAIAISGNLSNFLIHLGEKTYHYVPEFRKVSIAATIIYAYAWLVPLALWGFLMWRNSKVMNIVSYSFLEIVCVYGYSLFIYIPTAILWIIPQKAVRWILVMIALGISGSLLAMTFWPAVREDNRRVALATIVTIVLLHMLLSVGCLAYFFDAPEMDHLPTTTATPNQTVAAAKSS

SEQ ID NO: 1745 - protein, 255 aa, Homo sapiens
MQYLNIKEDCNAMAFCAKMRSSKKTEVNLEAPEPGVEVIFYLSDREPLRLGSGEYTAEELCIRAAQACRISPLCHNLFALYDENTKLWYAPNRTITVDDKMSLRLHYRMRFYFTNWHGTNDNEQSVWRHSPKKQKNGYEKKKIPDATPLLDASSLEYLFAQGQYDLVKCLAPIRDPKTEQDGHDIENECLGMAVLAISHYAMMKKMQLPELPKDISYKRYIPETLNKSIRQRNLLTRMRINNVFKDFLKEFNNKT

SEQ ID NO: 1746 - protein, 255 aa, Homo sapiens
MAEVHRRQHARVKGEAPAKSSTLRDEEELGMASAETLTVFLKLLAAGFYGVSSFLIVVVNKSVLTNYRFPSSLCVGLGQMVATVAVLWVGKALRVVKFPDLDRNVPRKTFPLPLLYFGNQITGLFSTKKLNLPMFTVLRRFSILFTMFAEGVLLKKTFSWGIKMTVFAMIIGAFVAASSDLAFDLEGYAFILINDVLTAANGAYVKQKLDSKELGKYGLLYYNALFMILPTLAIAYFTGDAQKAVEFEGWADTLF

SEQ ID NO: 1747 - protein, 229 aa, Homo sapiens
MGNASFGSKEQKLLKRLRLLPALLILRAFKPHRKIRDYRVVVVGTAGVGKSTLLHKWASGNFRHEYLPTIENTYCQLLGCSHGVLSLHITDSKSGDGNRALQRHVIARGHAFVLVYSVTKKETLEELKAFYELICKIKGNNLHKFPIVLVGNKSDDTHREVALNDGATCAMEWNCAFMEISAKTDVNVQELFHMLLNYKKKPTTGLQEPEKKSQMPNTTEKLLDKCIIM

SEQ ID NO: 1748 - protein, 255 aa, Homo sapiens
MAASRSTRVTRSTVGLNGLDESFCGRTLRNRSIAHPEEISSNSQVRSRSPKKRPEPVPIQKGNNNGRTTDLKQQSTRESWVSPRKRGLSSSEKDNIERQAIENCERRQTEPVSPVLKRIKRCLRSEAPNSSEEDSPIKSDKESVEQRSTVVDNDADFQGTKRACRCLILDDCEKREIKKVNVSEEGPLNSAVVEEITGYLAVNGVDDSDSAVINCDDCQPDGNTKQNSIGSYVLQEKSVAENGDTDTQTSMFLDS

SEQ ID NO: 1749 - protein, 68 aa, Homo sapiens
MSGSSSVAAMKKVVQQLRLEAGLNRVKVSQAAADLKQFCLQNAQHDPLLTGVSSSTNPFRPQKVCSFL

SEQ ID NO: 1750 - protein, 255 aa, Homo sapiens
MEFAAENEGKSGGGLHSVAEGVRLSPEPGREGVRDLAGAEEFGGGEEGTGLTGIKEIGDGEEGSGQRPEEIPMDLTVVKQEIIDWPGTEGRLAGQWVEQEVEDRPEVKDENAGVLEVKQETDSSLVVKEAKVGEPEVKEEKVKEEVMDWSEVKEEKDNLEIKQEEKFVGQCIKEELMHGECVKEEKDFLKKEIVDDTKVKEEPPINHPVGCKRKLAMSRCETCGTEEAKYRCPRCMRYSCSLPCVKKHKAELTCN

SEQ ID NO: 1751 - protein, 255 aa, Homo sapiens
MEKAVNDGSHSEELFCHLKTISEKEDLPRCTSESHLSCLKQDILNEKTELEATLKEAELVTHSVELLLPLFKDTIEKINFENANLSALNLKISEQKEILIKELDTFKSVKLALEHLLRKRDYKQTGDNLSSMLLENLTDNESENTNLKKKVFEKEAHIQELSCLFQSEKANTLKANRFSQSVKVVHERLQIQIHKREAENDKLKEYVKSLETKIAKWNLQSRMNKNEAIVMKEASRQKTVALKKASKVYKQRLDH

SEQ ID NO: 1752 - protein, 164 aa, Homo sapiens
MVAMAAGPSGCLVPAFGLRLLLATVLQAVSAFGAEFSSEACRELGFSSNLLCSSCDLLGQFNLLQLDPDCRGCCQEEAQFETKKLYAGAILEVCGKLGRFPQVQAFVRSDKPKLFRGLQIKYVRGSDPVLKLLDDNGNIAEELSILKWNTDSVEEFLSEKLERI

SEQ ID NO: 1753 - protein, 255 aa, Homo sapiens
MTMEGASGSSFGIDTILSSASSGSPGMMNGDFRPLGEARTADFRSQATPSPCSEIDTVGTAPSSPISVTMEPPEPHLVADATQHHHHLHHSQQPPPPAAAPTQSLQPLPQQQQPLPPQQPPPPPPQQLGSAASAPRTSTSSFLIKDILGDSKPLAACAPYSTSVSSPHHTPKQESNAVHESFRPKLEQEDSKTKLDKREDSQSDIKCHGTKEEGDREITSSRESPPVRAKKPRKARTAFSDHQLNQLERSFERQK

SEQ ID NO: 1754 - protein, 255 aa, Homo sapiens
MGTDSRAAKALLARARTLHLQTGNLLNWGRLRKKCPSTHSEELHDCIQKTLNEWSSQINPDLVREFPDVLECTVSHAVEKINPDEREEMKVSAKLFIVESNSSSSTRSAVDMACSVLGVAQLDSVIIASPPIEDGVNLSLEHLQPYWEELENLVQSKKIVAIGTSDLDKTQLEQLYQWAQVKPNSNQVNLASCCVMPPDLTAFAKQFDIQLLTHNDPKELLSEASFQEALQESIPDIQAHEWVPLWLLRYSVIVK

SEQ ID NO: 1755 - protein, 255 aa, Homo sapiens
MLCSLLLCECLLLVAGYAHDDDWIDPTDMLNYDAASGTMRKSQAKYGISGEKDVSPDLSCADEISECYHKLDSLTYKIDECEKKKREDYESQSNPVFRRYLNKILIEAGKLGLPDENKGDMHYDAEIILKRETLLEIQKFLNGEDWKPGALDDALSDILINFKFHDFETWKWRFEDSFGVDPYNVLMVLLCLLCIVVLVATELWTYVRWYTQLRRVLIISFLFSLGWNWMYLYKLAFAQHQAEVAKMEPLNNVCA

SEQ ID NO: 1756 - protein, 255 aa, Homo sapiens
MTFGQSKLYRSEDYGKNFKDITDLINNTFIRTEFGMAIGPENSGKVVLTAEVSGGSRGGRIFRSSDFAKNFVQTDLPFHPLTQMMYSPQNSDYLLALSTENGLWVSKNFGGKWEEIHKAVCLAKWGSDNTIFFTTYANGSCTDLGALELWRTSDLGKSFKTIGVKIYSFGLGGRFLFASVMADKDTTRRIHVSTDQGDTWSMAQLPSVGQEQFYSILAANDDMVFMHVDEPGDTGFGTIFTSDDRGIVYSKSLDR

SEQ ID NO: 1757 - protein, 255 aa, Homo sapiens
MLKREGKVQPYTKTLDGGWGWMIVIHFFLVNVFVMGMTKTFAIFFVVFQEEFEGTSEQIGWIGSIMSSLRFCAGPLVAIICDILGEKTTSILGAFVVTGGYLISSWATSIPFLCVTMGLLPGLGSAFLYQVAAVVTTKYFKKRLALSTAIARSGMGLTFLLAPFTKFLIDLYDWTGALILFGAIALNLVPSSMLLRPIHIKSENNSGIKDKGSSLSAHGPEAHATETHCHETEESTIKDSTTQKAGLPSKNLTVS

SEQ ID NO: 1758 - protein, 255 aa, Homo sapiens
MASNERDAISWYQKKIGAYDQQIWEKSIEQTQIKGLKNKPKKMGHIKPDLIDVDLIRGSTFAKAKPEIPWTSLTRKGLVRVVFFPLFSNWWIQVTSLRIFVWLLLLYFMQVIAIVLYLMMPIVNISEVLGPLCLMLLMGTVHCQIVSTQITRPSGNNGNRRRRKLRKTVNGDGSRENGNNSSDKVRGIETLESVPIIGGFWETIFGNRIKRVKLISNKGTETDNDPSCVHPIIKRRQCRPEIRMWQTREKAKFSD

SEQ ID NO: 1759 - protein, 255 aa, Homo sapiens
MFISGRRTADKWRAEERLQCPAGSARAALARCADGGAVGPFKCVFVGEMAAQVGAVRVVRAVAAQEEPDKEGKEKPHAGVSPRGVKRQRRSSSGGSQEKRGRPSQEPPLAPPHRRRRSRQHPGPLPPTNAAPTVPGPVEPLLLPPPPPPSLAPAGPAVAAPLPAPSTSALFTFSPLTVSAAGPKHKGHKERHKHHHHRGPDGDPSSCGTDLKHKDKQENGERTGGVPLIKAPKRETPDENGKTQRADDFVLKKIK

SEQ ID NO: 1760 - protein, 255 aa, Homo sapiens
MDVGFSRTTVQTLSRSHCKNIKQKISQWEGRANGISNPEKWCPKDFGVRYNCHQEIRLKKNPIAERKSKNLDVTSRENVGLDINENTKSHDQSENENKKHEYDDTHFFKNESESNWVCSRVKEIESCKEDVLDPETSLPPGNFYTSQILWKKIEALPPDKLLNLALEHCDSSEKELNFRVLDSSYGITKSLENIYSEPEGQECGPSINPLPKPRRTFRYLSESGVTPYKERNCDKKYCENNSCAQSSLASSQEPE

SEQ ID NO: 1761 - protein, 248 aa, Homo sapiens
MVAGSDAGRALGVLSVVCLLHCFGFISCFSQQIYGVVYGNVTFHVPSNVPLKEVLWKKQKDKVAELENSEFRAFSSFKNRVYLDTVSGSLTIYNLTSSDEDEYEMESPNITDTMKFFLYVLESLPSPTLTCALTNGSIEVQCMIPEHYNSHRGLIMYSWDCPMEQCKRNSTSIYFKMENDLPQKIQCTLSNPLFNTTSSIILTTCIPSSGHSRHRYALIPIPLAVITTCIVLYMNGILKCDRKPDRTK

SEQ ID NO: 1762 - protein, 255 aa, Homo sapiens
MAPKKEKGGTVNTSSKIWEPSLIAAQFNQNDWQASIAFVVGNQIEDDLLIQALTVAVQVPQRKLFSMVSWQDILQQINEINTLVGSASSKKAKKPVGGNAPLYYEVLTAAKAIMDSGEKLTLPLIGKLLKFQLLQIKFKDQQRRENEKKVIEDKPKLEKDKGKAKSPKEKKAPSAKPAKGKGKDQPEANAPVKKTTQLKRRGEDDHTNRYIDDEPDDGAQHYIIVVGFNNPQLLAIMAELGIPITSVIKISSENY

SEQ ID NO: 1763 - protein, 158 aa, Homo sapiens
MASRSMRLLLLLSCLAKTGVLGDIIMRPSCAPGWFYHKSNCYGYFRKLRNWSDAELECQSYGNGAHLASILSLKEASTIAEYISGYQRSQPIWIGLHDPQKRQQWQWIDGAMYLYRSWSGKSMGGNKHCAEMSSNNNFLTWSSNECNKRQHFLCKYRP

SEQ ID NO: 1764 - protein, 255 aa, Homo sapiens
MVKQNNIIPGETQILLRFTGWESKVNAKKQLPVGIKCEPMDQVPDSTSSATNVSMVVSAGPWSSEKAEMNILEINEKLRPQLAENKQQFRNLKERCFLTQLAGFLANRQKKYKYEECKDLIKFMLRNERQFKEEKLAEQLKQAEELRQYKVLVHSQERELTQLREKLREGRDASRSLNEHLQALLTPDEPDKSQGQDLQEQLAEGCRLAQHLVQKLSPENDEDEDEDVQVEEDEKVLESSAPREVQKAEESKVPE

SEQ ID NO: 1765 - protein, 195 aa, Homo sapiens
MGAAVFFGCTFVAFGPAFALFLITVAGDPLRVIILVAGRCSALPTTSCLISGLSFGIISGVFSVINILADALGPGVVGIHGDSPYYFLTSAFLTAAIILLHTFWGVVFFDACERRRYWALGLVVGSHLLTSGLTFLNPWYEASLLPIYAVTVSMGLWAFITAGGSLRSIQRSLLCRRQEDSRVMVYSALRIPPED

SEQ ID NO: 1766 - protein, 255 aa, Homo sapiens
MADTDLFMECEEEELEPWQKISDVIEDSVVEDYNSVDKTTTVSVSQQPVSAPVPIAAHASVAGHLSTSTTVSSSGAQNSDSTKKTLVTLIANNNAGNPLVQQGGQPLILTQNPAPGLGTMVTQPVLRPVQVMQNANHVTSSPVASQPIFITTQGFPVRNVRPVQNAMNQVGIVLNVQQGQTVRPITLVPAPGTQFVKPTVGVPQVFSQMTPVRPGSTMPVRPTTNTFTTVIPATLTIRSTVPQSQSQQTKSTPST

SEQ ID NO: 1767 - protein, 255 aa, Homo sapiens
MSTERTSWTSLSTIQKIALGLGIPASATVAYILYRRYRESREERLTFVGEDDIEIEMRVPQEAVKLIIGRQGANIKQLRKQTGARIDVDTEDVGDERVLLISGFPVQVCKAKAAIHQILTENTPVSEQLSVPQRSVGRIIGRGGETIRSICKASGAKITCDKESEGTLLLSRLIKISGTQKEVAAAKHLILEKVSEDEELRKRIAHSAETRVPRKQPISVRREDMTEPGGAGEPALWKNTSSSMEPTAPLVTPPP

SEQ ID NO: 1768 - protein, 240 aa, Homo sapiens
MLRSCAARLRTLGALCLPPVGRRLPGSEPRPELRSFSSEEVILKDCSVPNPSWNKDLRLLFDQFMKKCEDGSWKRLPSYKRTPTEWIQDFKTHFLDPKLMKEEQMSQAQLFTRSFDDGLGFEYVMFYNDIEKRMVCLFQGGPYLEGPPGFIHGGAIATMIDATVGMCAMMAGGIVMTANLNINYKRPIPLCSVVMINSQLDKVEGRKFFVSCNVQSVDEKTLYSEATSLFIKLNPAKSLT

SEQ ID NO: 1769 - protein, 105 aa, Homo sapiens
MAKISSPTETERCIESLIAVFQKYAGKDGYNYTLSKTEFLSFMNTELAAFTKNQKDPGVLDRMMKKLDTNSDGQLDFSEFLNLIGGLAMACHDSFLKAVPSQKRT

SEQ ID NO: 1770 - protein, 255 aa, Homo sapiens
MPQLLQNINGIIEAFRRYARTEGNCTALTRGELKRLLEQEFADVIVKPHDPATVDEVLRLLDEDHTGTVEFKEFLVLVFKVAQACFKTLSESAEGACGSQESGSLHSGASQELGEGQRSGTEVGRAGKGQHYEGSSHRQSQQGSRGQNRPGVQTQGQATGSAWVSSYDRQAESQSQERISPQIQLSGQTEQTQKAGEGKRNQTTEMRPERQPQTREQDRAHQTGETVTGSGTQTQAGATQTVEQDSSHQTGRTSK

SEQ ID NO: 1771 - protein, 92 aa, Homo sapiens
MTKLEEHLEGIVNIFHQYSVRKGHFDTLSKGELKQLLTKELANTIKNIKDKAVIDEIFQGLDANQDEQVDFQEFISLVAIALKAAHYHTHKE

SEQ ID NO: 1772 - protein, 93 aa, Homo sapiens
MLTELEKALNSIIDVYHKYSLIKGNFHAVYRDDLKKLLETECPQYIRKKGADVWFKELDINTDGAVNFQEFLILVIKMGVAAHKKSHEESHKE

SEQ ID NO: 1773 - protein, 255 aa, Homo sapiens
MDRMTEDALRLNLLKRSLDPADERDDVLAKRLKMEGHEAMERLKMLALLKRKDLANLEVPHELPTKQDGSGVKGYEEKLNGNLRPHGDNRTAGRPGKENINDEPVDMSARRSEPERGRLTPSPDIIVLSDNEASSPRSSSRMEERLKAANLEMFKGKGIEERQQLIKQLRDELRLEEARLVLLKKLRQSQLQKENVVQKTPVVQNAASIVQPSPAHVGQQGLSKLPSRPGAQGVEPQNLRTLQGHSVIRSATNTT

SEQ ID NO: 1774 - protein, 255 aa, Homo sapiens
MAEERPPRLVDYFVVAGLAGNGAPIPEETWVPEPSGPLRPPRPAEPITDVAVIARALGEEVPQGYTCIQASAGGHPLELSAGLLGGTQPVICYRRGRDKPPLVELGVLYEGKERPKPGFQVLDTTPYSHSANLAPPGPGHPRTYLTYRRAAEGAGLHALGITDLCLVLPSKGEGTPHTYCRLPRNLNPGMWGPAVYLCYKVGLAKANTLVYEAELLGRYPEEDNEAFPLPESVPVFCLPMGATIECWPAQTKYPV

SEQ ID NO: 1775 - protein, 255 aa, Homo sapiens
MASCPDSDNSWVLAGSESLPVETLGPASRMDPESERALQAPHSPSKTDGKELAGTMDGEGTLFQTESPQSGSILTEETEVKGTLEGDVCGVEPPGPGDTVVQGDLQETTVVTGLGPDTQDLEGQSPPQSLPSTPKAAWIREEGRCSSSDDDTDVDMEGLRRRRGREAGPPQPMVPLAVENQAGGEGAGGELGISLNMCLLGALVLLGLGVLLFSGGLSESETGPMEEVERQVLPDPEVLEAVGDRQDGLREQLQA

SEQ ID NO: 1776 - protein, 255 aa, Homo sapiens
MAASAPPPPDKLEGGGGPAPPPAPPSTGRKQGKAGLQMKSPEKKRRKSNTQGPAYSHLTEFAPPPTPMVDHLVASNPFEDDFGAPKVGVAAPPFLGSPVPFGGFRVQGGMAGQVPPGYSTGGGGGPQPLRRQPPPFPPNPMGPAFNMPPQGPGYPPPGNMNFPSQPFNQPLGQNFSPPSGQMMPGPVGGFGPMISPTMGQPPRAELGPPSLSQRFAQPGAPFGPSPLQRPGQGLPSLPPNTSPFPGPDPGFPGPG

SEQ ID NO: 1777 - protein, 255 aa, Homo sapiens
MDLLPPKPKYNPLRNESLSSLEEGASGSTPPEELPSPSASSLGPILPPLPGDDSPTTLCSFFPRMSNLRLANPAGGRPGSKGEPGRAADDGEGIVGAAMPDSGPLPLLQDMNKLSGGGGRRTRVEGGQLGGEEWTRHGSFVNKPTRGWLHPNDKVMGPGVSYLVRYMGCVEVLQSMRALDFNTRTQVTREAISLVCEAVPGAKGATRRRKPCSRPLSSILGRSNLKFAGMPITLTVSTSSLNLMAADCKQIIANH

SEQ ID NO: 1778 - protein, 255 aa, Homo sapiens
MPKVMKDVVHPLGGEEPSMARAVVRSVGGFTLGLSLATAYGLLELLVEGHSPWGCLVGTLTLAAFLSLGMGFSRQVRATVLLLLPQAFSRQGRTLLLVAAFGLVLQGPCANTLRNFTRASEAVACGAELALNQTAEVLQRAKQPLVSALNKIKAIARKTKEVADRVRKFFRSIMDGVKHIARALRNVWQWLLHIGDVCNSELGNPYLKCARVFDDAKDSCMMVIPQAYHLCYVLMPFKLALCGLASLVQVFCVIP

SEQ ID NO: 1779 - protein, 255 aa, Homo sapiens
MEFSSPSREECPKPLSRVSIMAGSLTGLLLLQAVSWASGARPCIPKSFGYSSVVCVCNATYCDSFDPPTFPALGTFSRYESTRSGRRMELSMGPIQANHTGTGLLLTLQPEQKFQKVKGFGGAMTDAAALNILALSPPAQNLLLKSYFSEEGIGYNIIRVPMASCDFSIRTYTYADTPDDFQLHNFSLPEEDTKLKIPLIHRALQLAQRPVSLLASPWTSPTWLKTNGAVNGKGSLKGQPGDIYHQTWARYFVKF

SEQ ID NO: 1780 - protein, 255 aa, Homo sapiens
MDPRNTAMLGLGSDSEGFSRKSPSAISTGTLVSKREVELEKNTKEEEDLRKRNRERNIEAGKDDGLTDAQQQFSVKETNFSEGNLKLKIGLQAKRTKKPPKNLENYVCRPAIKTTIKHPRKALKSGKMTDEKNEHCPSKRDPSKLYKKADDVAAIECQSEEVIRLHSQGENNPLSKKLSPVHSEMADYINATPSTLLGSRDPDLKDRALLNGGTSVTEKLAQLIATCPPSKSSKTKPKKLGTGTTAGLVSKDLIR

SEQ ID NO: 1781 - protein, 219 aa, Homo sapiens
MDSGTRPVGSCCSSPAGLSREYKLVMLGAGGVGKSAMTMQFISHRFPEDHDPTIEDAYKIRIRIDDEPANLDILDTAGQAEFTAMRDQYMRAGEGFIICYSITDRRSFHEVREFKQLIYRVRRTDDTPVVLVGNKSDLKQLRQVTKEEGLALAREFSCPFFETSAAYRYYIDDVFHALVREIRRKEKEAVLAMEKKSKPKNSVWKRLKSPFRKKKDSVT

SEQ ID NO: 1782 - protein, 255 aa, Homo sapiens
MGRKKIQIQRITDERNRQVTFTKRKFGLMKKAYELSVLCDCEIALIIFNHSNKLFQYASTDMDKVLLKYTEYNEPHESRTNADIIETLRKKGFNGCDSPEPDGEDSLEQSPLLEDKYRRASEELDGLFRRYGSTVPAPNFAMPVTVPVSNQSSLQFSNPSGSLVTPSLVTSSLTDPRLLSPQQPALQRNSVSPGLPQRPASAGAMLGGDLNSANGACPSPVGNGYVSARASPGLLPVANGNSLNKVIPAKSPPPP

SEQ ID NO: 1783 - protein, 255 aa, Homo sapiens
MESKYKEILLLTGLDNITDEELDRFKFFLSDEFNIATGKLHTANRIQVATLMIQNAGAVSAVMKTIRIFQKLNYMLLAKRLQEEKEKVDKQYKSVTKPKPLSQAEMSPAASAAIRNDVAKQRAAPKVSPHVKPEQKQMVAQQESIREGFQKRCLPVMVLKAKKPFTFETQEGKQEMFHATVATEKEFFFVKVFNTLLKDKFIPKRIIIIARYYRHSGFLEVNSASRVLDAESDQKVNVPLNIIRKAGETPKINTL

SEQ ID NO: 1784 - protein, 255 aa, Homo sapiens
MLTKFETKSARVKGLSFHPKRPWILTSLHNGVIQLWDYRMCTLIDKFDEHDGPVRGIDFHKQQPLFVSGGDDYKIKVWNYKLRRCLFTLLGHLDYIRTTFFHHEYPWILSASDDQTIRVWNWQSRTCVCVLTGHNHYVMCAQFHPTEDLVVSASLDQTVRVWDISGLRKKNLSPGAVESDVRGITGVDLFGTTDAVVKHVLEGHDRGVNWAAFHPTMPLIVSGADDRQVKIWRMNESKAWEVDTCRGHYNNVSCA

SEQ ID NO: 1785 - protein, 255 aa, Homo sapiens
MAGLKRRASQVWPEEHGEQEHGLYSLHRMFDIVGTHLTHRDVRVLSFLFVDVIDDHERGLIRNGRDFLLALERQGRCDESNFRQVLQLLRIITRHDLLPYVTLKRRRAVCPDLVDKYLEETSIRYVTPRALSDPEPRPPQPSKTVPPHYPVVCCPTSGPQMCSKRPARGRATLGSQRKRRKSVTPDPKEKQTCDIRLRVRAEYCQHETALQGNVFSNKQDPLERQFERFNQANTILKSRDLGSIICDIKFSELTY

SEQ ID NO: 1786 - protein, 255 aa, Homo sapiens
MATFVSELEAAKKNLSEALGDNVKQYWANLKLWFKQKISKEEFDLEAHRLLTQDNVHSHNDFLLAILTRCQILVSTPDGAGSLPWPGGSAAKPGKPKGKKKLSSVRQKFDHRFQPQNPLSGAQQFVAKDPQDDDDLKLCSHTMMLPTRGQLEGRMIVTAYEHGLDNVTEEAVSAVVYAVENHLKDILTSVVSRRKAYRLRDGHFKYAFGSNVTPQPYLKNSVVAYNNLIESPPAFTAPCAGQNPASHPPPDDAEQ

SEQ ID NO: 1787 - protein, 255 aa, Homo sapiens
MVGKMWPVLWTLCAVRVTVDAISVETPQDVLRASQGKSVTLPCTYHTSTSSREGLIQWDKLLLTHTERVVIWPFSNKNYIHGELYKNRVSISNNAEQSDASITIDQLTMADNGTYECSVSLMSDLEGNTKSRVRLLVLVPPSKPECGIEGETIIGNNIQLTCQSKEGSPTPQYSWKRYNILNQEQPLAQPASGQPVSLKNISTDTSGYYICTSSNEEGTQFCNITVAVRSPSMNVALYVGIAVGVVAALIIIGII

SEQ ID NO: 1788 - protein, 163 aa, Homo sapiens
MKWKALFTAAILQAQLPITEAQSFGLLDPKLCYLLDGILFIYGVILTALFLRVKFSRSADAPAYQQGQNQLYNELNLGRREEYDVLDKRRGRDPEMGGKPRRKNPQEGLYNELQKDKMAEAYSEIGMKGERRRGKGHDGLYQGLSTATKDTYDALHMQALPPR

SEQ ID NO: 1789 - protein, 255 aa, Homo sapiens
MFPGCPRLWVLVVLGTSWVGWGSQGTEAAQLRQFYVAAQGISWSYRPEPTNSSLNLSVTSFKKIVYREYEPYFKKEKPQSTISGLLGPTLYAEVGDIIKVHFKNKADKPLSIHPQGIRYSKLSEGASYLDHTFPAEKMDDAVAPGREYTYEWSISEDSGPTHDDPPCLTHIYYSHENLIEDFNSGLIGPLLICKKGTLTEGGTQKTFDKQIVLLFAVFDESKSWSQSSSLMYTVNGYVNGTMPDITVCAHDHISW

SEQ ID NO: 1790 - protein, 255 aa, Homo sapiens
MGNREMEELIPLVNRLQDAFSALGQSCLLELPQIAVVGGQSAGKSSVLENFVGRDFLPRGSGIVTRRPLVLQLVTSKAEYAEFLHCKGKKFTDFDEVRLEIEAETDRVTGMNKGISSIPINLRVYSPHVLNLTLIDLPGITKVPVGDQPPDIEYQIREMIMQFITRENCLILAVTPANTDLANSDALKLAKEVDPQGLRTIGVITKLDLMDEGTDARDVLENKLLPLRRGYVGVVNRSQKDIDGKKDIKAAMLAE

SEQ ID NO: 1791 - protein, 99 aa, Homo sapiens
MERISAFFSSIWDTILTKHQEGIYNTICLGVLLGLPLLVIITLLFICCHCCWSPPGKRGQQPEKNKKKKKKKKKKDEEDLWISAQPKLLQMEKRPSLPV

SEQ ID NO: 1792 - protein, 255 aa, Homo sapiens
MADSGLREPQEDSQKDLENDPSVNSQAQETTIIASNAEEAEILHSACGLSKDHQEVETEGPESADTGDKSESPDEANVGKHPKDKTEDENKQSFLDGGKGHHLPSENLGKEPLDPDPSHSPSDKVGRADAHLGSSSVALPKEASDGTGASQEPPTTDSQEAQSPGHSSAGQEGEDTLRRRLLAPEAGSHPQQTQKLEEIKENAQDTMRQINKKGFWSYGPVILVVLVVAVVASSVNSYYSSPAQQVPKNPALEAF

SEQ ID NO: 1793 - protein, 255 aa, Homo sapiens
MEGTEAAAAKPAGGSPQGPKTGSGTASPVEGTSAVEWSGPEPQLDNGHPPRPWPCPQENRTSSLMAPQPPRVWGVQLQGPSVLESKVRALKEKMTVAKQGVSPCSASQEWSSPKKPQCRRGKAGRAGTPSEGSFLPGAVVAPRTQNLPDGQLDGSINEEQPARDGGPRLPRPPAPGREYCNRGSPWPPEAEWTLPDHDRGPLLGPSSLQQSPIHGVTPGRPGGPGHCNKIIHIPSPRTGRSYPFPDGVVTEADLD

SEQ ID NO: 1794 - protein, 255 aa, Homo sapiens
MSEAGGRGCGSPVPQRARWRLVAATAAFCLVSATSVWTAGAEPMSREEKQKLGNQVLEMFDHAYGNYMEHAYPADELMPLTCRGRVRGQEPSRGDVDDALGKFSLTLIDSLDTLVVLNKTKEFEDAVRKVLRDVNLDNDVVVSVFETNIRVLGGLLGGHSLAIMLKEKGEYMQWYNDELLQMAKQLGYKLLPAFNTTSGLPYPRINLKFGIRKPEARTGTETDTCTACAGTLILEFAALSRFTGATIFEEYARKA

SEQ ID NO: 1795 - protein, 255 aa, Homo sapiens
MTGNAGEWCLMESDPGVFTELIKGFGCRGAQVEEIWSLEPENFEKLKPVHGLIFLFKWQPGEEPAGSVVQDSRLDTIFFAKQVINNACATQAIVSVLLNCTHQDVHLGETLSEFKEFSQSFDAAMKGLALSNSDVIRQVHNSFARQQMFEFDTKTSAKEEDAFHFVSYVPVNGRLYELDGLREGPIDLGACNQDDWISAVRPVIEKRIQKYSEGEIRFNLMAIVSDRKMIYEQKIAELQRQLAEEEPMDTDQGNS

SEQ ID NO: 1796 - protein, 255 aa, Homo sapiens
MDCRTKANPDRTFDLVLKVKCHASENEDPVVLWKFPEDFGDQEILQSVPKFCFPFDVERVSQNQVGQHFTFVLTDIESKQRFGFCRLTSGGTICLCILSYLPWFEVYYKLLNTLADYLAKELENDLNETLRSLYNHPVPKANTPVNLSVNQEIFIACEQVLKDQPALVPHSYFIAPDVTGLPTIPESRNLTEYFVAVDVNNMLQLYASMLHERRIVIISSKLSTLTACIHGSAALLYPMYWQHIYIPVLPPHLLD

SEQ ID NO: 1797 - protein, 255 aa, Homo sapiens
MFVPRSLKIKRNANDDGKSCVAKIIKPDPEDLQLDKSRDVPVDAVATEAATIDRHISESCPFPSPGGQLAEVHSVSPEQGAKDSHPSEEPVKSFSKTQRWAEPGEPICVVCGRYGEYICDKTDEDVCSLECKAKHLLQVKEKEEKSKLSNPQKADSEPESPLNASYVYKEHPFILNLQEDQIENLKQQLGILVQGQEVTRPIIDFEHCSLPEVLNHNLKKSGYEVPTPIQMQMIPVGLLGRDILASADTGSGKTA

SEQ ID NO: 1798 - protein, 255 aa, Homo sapiens
MAGQGDCCVKVAVRIRPQLSKEKIEGCHICTSVTPGEPQVLLGKDKAFTYDFVFDLDTWQEQIYSTCVSKLIEGCFEGYNATVLAYGQTGAGKTYTMGTGFDMATSEEEQGIIPRAIAHLFGGIAERKRRAQEQGVAGPEFKVSAQFLELYNEEILDLFDSTRDPDTRHRRSNIKIHEDANGGIYTTGVTSRLIHSQEELIQCLKQGALSRTTASTQMNVQSSRSHAIFTIHLCQMRMCTQPDLVNEAVTGLPDG

SEQ ID NO: 1799 - protein, 186 aa, Homo sapiens
MIALFNKLLDWFKALFWKEEMELTLVGLQYSGKTTFVNVIASGQFNEDMIPTVGFNMRKITKGNVTIKLWDIGGQPRFRSMWERYCRGVSAIVYMVDAADQEKIEASKNELHNLLDKPQLQGIPVLVLGNKRDLPGALDEKELIEKMNLSAIQDREICCYSISCKEKDNIDITLQWLIQHSKSRRS

SEQ ID NO: 1800 - protein, 255 aa, Homo sapiens
MGIQTSPVLLASLGVGLVTLLGLAVGSYLVRRSRRPQVTLLDPNEKYLLRLLDKTTVSHNTKRFRFALPTAHHTLGLPVGKHIYLSTRIDGSLVIRPYTPVTSDEDQGYVDLVIKVYLKGVHPKFPEGGKMSQYLDSLKVGDVVEFRGPSGLLTYTGKGHFNIQPNKKSPPEPRVAKKLGMIAGGTGITPMLQLIRAILKVPEDPTQCFLLFANQTEKDIILREDLEELQARYPNRFKLWFTLDHPPKDWAYSKG

SEQ ID NO: 1801 - protein, 255 aa, Homo sapiens
MMEKNTSEGPACSPEETASESAKVPTAEPPGEVAVSESTREEQVPKPQAPAPQAPTASTATKPAPPSEDVPSAPLLLTLDDVSSSSVTVSWEPPERLGRLGLQGYVLELCREGASEWVPVSARPMMVTQQTVRNLALGDKFLLRVSAVSSAGAGPPAMLDQPIHIRENIEAPKIRVPRHLRQTYIRQVGETVNLQIPFQGKPKPQATWTHNGHALDSQRVSMRTGDQDSILFIRSAQRSDSGRYELTVRVEDLEA

SEQ ID NO: 1802 - protein, 255 aa, Homo sapiens
MGVKASQTGFVVLVLLQCCSAYKLVCYYTSWSQYREGDGSCFPDALDRFLCTHIIYSFANISNDHIDTWEWNDVTLYGMLNTLKNRNPNLKTLLSVGGWNFGSQRFSKIASNTQSRRTFIKSVPPFLRTHGFDGLDLAWLYPGRRDKQHFTTLIKEMKAEFIKEAQPGKKQLLLSAALSAGKVTIDSSYDIAKISQHLDFISIMTYDFHGAWRGTTGHHSPLFRGQEDASPDRFSNTDYAVGYMLRLGAPASKLV

SEQ ID NO: 1803 - protein, 255 aa, Homo sapiens
MSSTQGNGEHWKSLESVGISRKELAMAEALQMEYDALSRLRHDKEENRAKQNADPSLISWDEPGVDFYSKPAGRRTDLKLLRGLSGSDPTLNYNSLSPQEGPPNHSTSQGPQPGSDPWPKGSLSGDYLYIFDGSDGGVSSSPGPGDIEGSCKKLSPPPLPPRASIWDTPPLPPRKGSPSSSKISQPSDINTFSLVEQLPGKLLEHRILEEEEVLGGGGQGRLLGSVDYDGINDAITRLNLKSTYDAEMLRDATRG

SEQ ID NO: 1804 - protein, 255 aa, Homo sapiens
MESLVFARRSGPTPSAAELARPLAEGLIKSPKPLMKKQAVKRHHHKHNLRHRYEFLETLGKGTYGKVKKARESSGRLVAIKSIRKDKIKDEQDLMHIRREIEIMSSLNHPHIIAIHEVFENSSKIVIVMEYASRGDLYDYISERQQLSEREARHFFRQIVSAVHYCHQNRVVHRDLKLENILLDANGNIKIADFGLSNLYHQGKFLQTFCGSPLYASPEIVNGKPYTGPEVDSWSLGVLLYILVHGTMPFDGHDH

SEQ ID NO: 1805 - protein, 243 aa, Homo sapiens
MSRPVRNRKVVDYSQFQESDDADEDYGRDSGPPTKKIRSSPREAKNKRRSGKNSQEDSEDSEDKDVKTKKDDSHSAEDSEDEKEDHKNVRQQRQAASKAASKQREMLMEDVGSEEEQEEEDEAPFQEKDSGSDEDFLMEDDDDSDYGSSKKKNKKMVKKSKPERKEKKMPKPRLKATVTPSPVKGKGKVGRPTASKASKEKTPSPKEEDEEPESPPEKKTSTSPPPEKSGDEGSEDEAPSGED

SEQ ID NO: 1806 - protein, 255 aa, Homo sapiens
MDFWLWPLYFLPVSGALRILPEVKVEGELGGSVTIKCPLPEMHVRIYLCREMAGSGTCGTVVSTTNFIKAEYKGRVTLKQYPRKNLFLVEVTQLTESDSGVYACGAGMNTDRGKTQKVTLNVHSEYEPSWEEQPMPETPKWFHLPYLFQMPAYASSSKFVTRVTTPAQRGKVPPVHHSSPTTQITHRPRVSRASSVAGDKPRTFLPSTTASKISALEGLLKPQTPSYNHHTRLHRQRALDYGSQSGREGQGFHIL

SEQ ID NO: 1807 - protein, 255 aa, Homo sapiens
MEQRRPWPRALEVDSRSVVLLSVVWVLLAPPAAGMPQFSTFHSENRDWTFNHLTVHQGTGAVYVGAINRVYKLTGNLTIQVAHKTGPEEDNKSCYPPLIVQPCSEVLTLTNNVNKLLIIDYSENRLLACGSLYQGVCKLLRLDDLFILVEPSHKKEHYLSSVNKTGTMYGVIVRSEGEDGKLFIGTAVDGKQDYFPTLSSRKLPRDPESSAMLDYELHSDFVSSLIKIPSDTLALVSHFDIFYIYGFASGGFVYF

SEQ ID NO: 1808 - protein, 255 aa, Homo sapiens
MGCWGRNRGRLLCMLALTFMFMVLEVVVSRVTSSLAMLSDSFHMLSDVLALVVALVAERFARRTHATQKNTFGWIRAEVMGALVNAIFLTGLCFAILLEAIERFIEPHEMQQPLVVLGVGVAGLLVNVLGLCLFHHHSGFSQDSGHGHSHGGHGHGHGLPKGPRVKSTRPGSSDINVAPGEQGPDQEETNTLVANTSNSNGLKLDPADPENPRSGDTVEVQVNGNLVREPDHMELEEDRAGQLNMRGVFLHVLGD

SEQ ID NO: 1809 - protein, 255 aa, Homo sapiens
MAITLEEAPWLGWLLVKALMRFAFMVVNNLVAIPSYICYVIILQPLRVLDSKRFWYIEGIMYKWLLGMVASWGWYAGYTVMEWGEDIKAVSKDEAVMLVNHQATGDVCTLMMCLQDKGLVVAQMMWLMDHIFKYTNFGIVSLVHGDFFIRQGRSYRDQQLLLLKKHLENNYRSRDRKWIVLFPEGGFLRKRRETSQAFAKKNNLPFLTNVTLPRSGATKIILNALVAQQKNGSPAGGDAKELDSKSKGLQWIIDT

SEQ ID NO: 1810 - protein, 255 aa, Homo sapiens
MEAWRCVRKGYGHCVVGRGRYPMFPHHSRSLGRDWTTPWENLQRCCWNRHISSCMRWPGHYSRAPYPYFSSRHFSLNWRPPCLFESRTQFQYCNWRPDNLSQTSLIHLSSYVMNAEGDEPSSKRRKHQGVIKRNWEYICSHDKEKTKILGDKNVDPKCEDSENKFDFSVMSYNILSQDLLEDNSHLYRHCRRPVLHWSFRFPNILKEIKHFDADVLCLQEVQEDHYGAEIRPSLESLGYHCEYKMRTGRKPDGCA

SEQ ID NO: 1811 - protein, 255 aa, Homo sapiens
MACSIVQFCYFQDLQAARDFLFPHLREEILSGALRRDPSKSTDWEDDGWGAWEENEPQEPEEEGNTCKTQKTSWLQDCVLSLSPTNDLMVIAREQKAVFLVPKWKYSDKGKEEMQFAVGWSGSLNVEEGECVTSALCIPLASQKRSSTGRPDWTCIVVGFTSGYVRFYTENGVLLLAQLLNEDPVLQLKCRTYEIPRHPGVTEQNEELSILYPAAIVTIDGFSLFQSLRACRNQVAKAAASGNENIQPPPLAYKK

SEQ ID NO: 1812 - protein, 255 aa, Homo sapiens
MDLTLAELQEMASRQQQQIEAQQQLLATKEQRLKFLKQQDQRQQQQVAEQEKLKRLKEIAENQEAKLKKVRALKGHVEQKRLSNGKLVEEIEQMNNLFQQKQRELVLAVSKVEELTRQLEMLKNGRIDSHHDNQSAVAELDRLYKELQLRNKLNQEQNAKLQQQRECLNKRNSEVAVMDKRVNELRDRLWKKKAALQQKENLPVSSDGNLPQQAASAPSRVAAVGPYIQSSTMPRMPSRPELLVKPALPDGSLVI

SEQ ID NO: 1813 - protein, 255 aa, Homo sapiens
MKPRPAGFVDNKLKQRVIQYLTSNKCGKYVDIGVLASDLQRVYSIDYGRRKRNAFRIQVEKVFSIISSEKELKNLTELEDEHLAKRARQGEEDNEYTESYSDDDSSMEDYPDPQSANHMNSSLLSLYRKGNPDSVSNTPEMEQRETTSSTPRISSKTGSIPLKTPAKDSEGGWFIDKTPSVKKDSFFLDLSCEKSNPKKPITEIQDSKDSSLLESDMKRKGKLKNKGSKRKKEDLQEVDGEIEAVLQKKAKARGL

SEQ ID NO: 1814 - protein, 255 aa, Homo sapiens
MMDSPFLELWQSKAVSIREQLGLGDRPNDSYCYNSAKNSTVLQGVTFGGIPTVLLIDVSCFLFLILVFSIIRRRFWDYGRIALVSEADSESRFQRLSSTSSSGQQDFENELGCCPWLTAIFRLHDDQILEWCGEDAIHYLSFQRHIIFLLVVVSFLSLCVILPVNLSGDLLDKDPYSFGRTTIANLQTDNDLLWLHTIFAVIYLFLTVGFMRHHTQSIKYKEENLVRRTLFITGLPRDARKETVESHFRDAYPTC

SEQ ID NO: 1815 - protein, 255 aa, Homo sapiens
MAESSDKLYRVEYAKSGRASCKKCSESIPKDSLRMAIMVQSPMFDGKVPHWYHFSCFWKVGHSIRHPDVEVDGFSELRWDDQQKVKKTAEAGGVTGKGQDGIGSKAEKTLGDFAAEYAKSNRSTCKGCMEKIEKGQVRLSKKMVDPEKPQLGMIDRWYHPGCFVKNREELGFRPEYSASQLKGFSLLATEDKEALKKQLPGVKSEGKRKGDEVDGVDEVAKKKSKKEKDKDSKLEKALKAQNDLIWNIKDELKKV

SEQ ID NO: 1816 - protein, 255 aa, Homo sapiens
MAVYCYALNSLVIMNSANEMKSGGGPGPSGSETPPPPRRAVLSPGSVFSPGRGASFLFPPAESLSPEEPRSPGGWRSGRRRLNSSSGSGSGSSGSSVSSPSWAGRLRGDRQQVVAAGTLSPPGPEEAKRKLRILQRELQNVQVNQKVGMFEAHIQAQSSAIQAPRSPRLGRARSPSPCPFRSSSQPPGRVLVQGARSEERRTKSWGEQCPETSGTDSGRKGGPSLCSSQVKKGMPPLPGRAAPTGSEAQGPSAFV

SEQ ID NO: 1817 - protein, 255 aa, Homo sapiens
MEWVLAEALLSQSRDPRALLGALCQGEASAERVETLRFLLQRLEDEEARGSGGAGALPEAAREVAAGYLVPLLRSLRGRPAGGPDPSLQPRHRRRVLRAAGAALRSCVRLAGRPQLAAALAEEALRDLLAGWRAPGAEAAVEVLAAVGPCLRPREDGPLLERVAGTAVALALGGGGDGDEAGPAEDAAALVAGRLLPVLVQCGGAALRAVWGGLAAPGASLGSGRVEEKLLVLSALAEKLLPEPGGDRARGAREA

SEQ ID NO: 1818 - protein, 255 aa, Homo sapiens
MADNLPTEFDVVIIGTGLPESILAAACSRSGQRVLHIDSRSYYGGNWASFSFSGLLSWLKEYQQNNDIGEESTVVWQDLIHETEEAITLRKKDETIQHTEAFCYASQDMEDNVEEIGALQKNPSLGVSNTFTEVLDSALPEESQLSYFNSDEMPAKHTQKSDTEISLEVTDVEESVEKEKYCGDKTCMHTVSDKDGDKDESKSTVEDKADEPIRNRITYSQIVKEGRRFNIDLVSKLLYSQGLLIDLLIKSDVSR

SEQ ID NO: 1819 - protein, 255 aa, Homo sapiens
MSDVTIVKEGWVQKRGEYIKNWRPRYFLLKTDGSFIGYKEKPQDVDLPYPLNNFSVAKCQLMKTERPKPNTFIIRCLQWTTVIERTFHVDTPEEREEWTEAIQAVADRLQRQEEERMNCSPTSQIDNIGEEEMDASTTHHKRKTMNDFDYLKLLGKGTFGKVILVREKASGKYYAMKILKKEVIIAKDEVAHTLTESRVLKNTRHPFLTSLKYSFQTKDRLCFVMEYVNGGELFFHLSRERVFSEDRTRFYGAEI

SEQ ID NO: 1820 - protein, 255 aa, Homo sapiens
MEPLKVEKFATAKRGNGLRAVTPLRPGELLFRSDPLAYTVCKGSRGVVCDRCLLGKEKLMRCSQCRVAKYCSAKCQKKAWPDHKRECKCLKSCKPRYPPDSVRLLGRVVFKLMDGAPSESEKLYSFYDLESNINKLTEDKKEGLRQLVMTFQHFMREEIQDASQLPPAFDLFEAFAKVICNSFTICNAEMQEVGVGLYPSISLLNHSCDPNCSIVFNGPHLLLRAVRDIEVGEELTICYLDMLMTSEERRKQLRD

SEQ ID NO: 1821 - protein, 255 aa, Homo sapiens
MAAERRCGSMRDLRAQVTSGLLPFPEVTLQALGEDEITLESVLRGKFAAGKNGLACLACGPQLEVVNSITGERLSAYRFSGVNEQPPVVLAVKEFSWQKRTGLLIGLEETEGSVLCLYDLGISKVVKAVVLPGRVTAIEPIINHGGASASTQHLHPSLRWLFGVAAVVTDVGQILLVDLCLDDLSCNQNEVEASDLEVLTGIPAEVPHIRESVMRQGRHLCFQLVSPTGTAVSTLSYISRTNQLAVGFSDGYLAL

SEQ ID NO: 1822 - protein, 255 aa, Homo sapiens
MEKRNLTVVREFVLLGLPSSAEQQHLLSVLFLCMYLATTLGNMLIIATIGFDSHLHSPMYFFLSNLAFVDICFTSTTVPQMVVNILTGTKTISFAGCLTQLFFFVSFVNMDSLLLCVMAYDRYVAICHPLHYTARMNLCLCVQLVAGLWLVTYLHALLHTVLIAQLSFCASNIIHHFFCDLNPLLQLSCSDVSFNVMIIFAVGGLLALTPLVCILVSYGLIFSTVLKITSTQGKQRAVSTCSCHLSVVVLFYGTA

SEQ ID NO: 1823 - protein, 255 aa, Homo sapiens
MSGLGDSSSDPANPDSHKRKGSPCDTLASSTEKRRREQENKYLEELAELLSANISDIDSLSVKPDKCKILKKTVDQIQLMKRMEQEKSTTDDDVQKSDISSSSQGVIEKESLGPLLLEALDGFFFVVNCEGRIVFVSENVTSYLGYNQEELMNTSVYSILHVGDHAEFVKNLLPKSLVNGVPWPQEATRRNSHTFNCRMLIHPPDEPGTENQEACQRYEVMQCFTVSQPKSIQEDGEDFQSCLICIARRLPRPPA

SEQ ID NO: 1824 - protein, 255 aa, Homo sapiens
MTILTYPFKNLPTASKWALRFSIRPLSCSSQLRAAPAVQTKTKKTLAKPNIRNVVVVDGVRTPFLLSGTSYKDLMPHDLARAALTGLLHRTSVPKEVVDYIIFGTVIQEVKTSNVAREAALGAGFSDKTPAHTVTMACISANQAMTTGVGLIASGQCDVIVAGGVELMSDVPIRHSRKMRKLMLDLNKAKSMGQRLSLISKFRFNFLAPELPAVSEFSTSETMGHSADRLAAAFAVSRLEQDEYALRSHSLAKKA

SEQ ID NO: 1825 - protein, 255 aa, Homo sapiens
MLSSFLSPQNGTWADTFSLLLALAVALYLGYYWACVLQRPRLVAGPQFLAFLEPHCSITTETFYPTLWCFEGRLQSIFQVLLQSQPLVLYQSDILQTPDGGQLLLDWAKQPDSSQDPDPTTQPIVLLLPGITGSSQETYVLHLVNQALRDGYQAVVFNNRGCRGEELRTHRAFCASNTEDLETVVNHIKHRYPQAPLLAVGISFGGILVLNHLAQARQAAGLVAALTLSACWDSFETTRSLETPLNSLLFNQPLT

SEQ ID NO: 1826 - protein, 255 aa, Homo sapiens
MNSPGGRGKKKGSGGASNPVPPRPPPPCLAPAPPAAGPAPPPESPHKRNLYYFSYPLFVGFALLRLVAFHLGLLFVWLCQRFSRALMAAKRSSGAAPAPASASAPAPVPGGEAERVRVFHKQAFEYISIALRIDEDEKAGQKEQAVEWYKKGIEELEKGIAVIVTGQGEQCERARRLQAKMMTNLVMAKDRLQLLEKMQPVLPFSKSQTDVYNDSTNLACRNGHLQSESGAVPKRKDPLTHTSNSLPRSKTVMKT

SEQ ID NO: 1827 - protein, 255 aa, Homo sapiens
MPGKLLWGDIMELEAPLEESESQKKERQKSDRRKSRHHYDSDEKSETRENGVTDDLDAPKAKKSKMKEKLNGDTEEGFNRLSDEFSKSHKSRRKDLPNGDIDEYEKKSKRVSSLDTSTHKSSDNKLEETLTREQKEGAFSNFPISEETIKLLKGRGVTYLFPIQVKTFGPVYEGKDLIAQARTGTGKTFSFAIPLIERLQRNQETIKKSRSPKVLVLAPTRELANQVAKDFKDITRKLSVACFYGGTSYQSQINH

SEQ ID NO: 1828 - protein, 101 aa, Homo sapiens
MVCEKCEKKLGTVITPDTWKDGARNTTESGGRKLNENKALTSKKARFDPYGKNKFSTCRICKSSVHQPGSHYCQGCAYKKGICAMCGKKVLDTKNYKQTSV

SEQ ID NO: 1829 - protein, 255 aa, Homo sapiens
MAVQPKETLQLESAAEVGFVRFFQGMPEKPTTTVRLFDRGDFYTAHGEDALLAAREVFKTQGVIKYMGPAGAKNLQSVVLSKMNFESFVKDLLLVRQYRVEVYKNRAGNKASKENDWYLAYKASPGNLSQFEDILFGNNDMSASIGVVGVKMSAVDGQRQVGVGYVDSIQRKLGLCEFPDNDQFSNLEALLIQIGPKECVLPGGETAGDMGKLRQIIQRGGILITERKKADFSTKDIYQDLNRLLKGKKGEQMNS

SEQ ID NO: 1830 - protein, 255 aa, Homo sapiens
MGPVIGMTPDKRAETPGAEKIAGLSQIYKMGSLPEAVDAARPKATLVDSESADDELTNLNWLHESTNLLTNFSLGSEGLPIVSPLYDIEGDDVPSFGPACYQNPEKKSATSKPPYSFSLLIYMAIEHSPNKCLPVKEIYSWILDHFPYFATAPTGWKNSVRHNLSLNKCFQKVERSHGKVNGKGSLWCVDPEYKPNLIQALKKQPFSSASSQNGSLSPHYLSSVIKQNQVRNLKESDIDAAAAMMLLNTSIEQGI

SEQ ID NO: 1831 - protein, 255 aa, Homo sapiens
MAAEEEDEVEWVVESIAGFLRGPDWSIPILDFVEQKCEVFDDEEESKLTYTEIHQEYKELVEKLLEGYLKEIGINEDQFQEACTSPLAKTHTSQAILQPVLAAEDFTIFKAMMVQKNIEMQLQAIRIIQERNGVLPDCLTDGSDVVSDLEHEEMKILREVLRKSKEEYDQEEERKRKKQLSEAKTEEPTVHSSEAAIMNNSQGDGEHFAHPPSEVKMHFANQSIEPLGRKVERSETSSLPQKDLKIPGLEHASIE

SEQ ID NO: 1832 - protein, 255 aa, Homo sapiens
MAVTEASLLRQCPLLLPQNRSKTVYEGFISAQGRDFHLRIVLPEDLQLKNARLLCSWQLRTILSGYHRIVQQRMQHSPDLMSFMMELKMLLEVALKNRQELYALPPPPQFYSSLIEEIGTLGWDKLVYADTCFSTIKLKAEDASGREHLITLKLKAKYPAESPDYFVDFPVPFCASWTPQSSLISIYSQFLAAIESLKAFWDVMDEIDEKTWVLEPEKPPRSATARRIALGNNVSINIEVDPRHPTMLPECFFLG

SEQ ID NO: 1833 - protein, 137 aa, Homo sapiens
MILPTKAMATQELTVKRKLSGNTLQVQASSPVALGVRIPTVALHMMELFDTTVEQLYSIFTVKELTNKKIIMKWRCGNWPEEHYAMVALNFVPTLGQTELQLKEFLSICKEENMKFCWQKQHFEEIKGSLQLTPLNG

SEQ ID NO: 1834 - protein, 255 aa, Homo sapiens
MMSYLKQPPYGMNGLGLAGPAMDLLHPSVGYPATPRKQRRERTTFTRSQLDVLEALFAKTRYPDIFMREEVALKINLPESRVQVWFKNRRAKCRQQQQSGSGTKSRPAKKKSSPVRESSGSESSGQFTPPAVSSSASSSSSASSSSANPAAAAAAGLGGNPVAAASSLSTPAASSIWSPASISPGSAPASVSVPEPLAAPSNTSCMQRSVAAGAATAAASYPMSYGQGGSYGQGYPTPSSSYFGGVDCSSYLAPM

SEQ ID NO: 1835 - protein, 138 aa, Homo sapiens
MYAAGLGMLEPTKEPLKPLSAAEKIASIGQTATMSPDMNTCTSDQFQESLPPVQFDWSSSGLTNPLDGVDPELYELTTSKLEISTSSLKVTDAFARLMSTVEKTSTSTRKPKREGHLSEEAIKVIAGLPDLTFMHAKV

SEQ ID NO: 1836 - protein, 690 aa, Homo sapiens
MALGEEKAEAEASEDTKAQSYGRGSCRERELDIPGPMSGEQPPRLEAEGGLISPVWGAEGIPAPTCWIGTDPGGPSRAHQPQASDANREPVAERSEPALSGLPPATMGSGDLLLSGESQVEKTKLSSSEEFPQTLSLPRTTTICSGHDADTEDDPSLADLPQALDLSQQPHSSGLSCLSQWKSVLSPGSAAQPSSCSISASSTGSSLQGHQERAEPRGGSLAKVSSSLEPVVPQEPSSVVGLGPRPQWSPQPVFSGGDASGLGRRRLSFQAEYWACVLPDSLPPSPDRHSPLWNPNKEYEDLLDYTYPLRPGPQLPKHLDSRVPADPVLQDSGVDLDSFSVSPASTLKSPTNVSPNCPPAEATALPFSGPREPSLKQWPSRVPQKQGGMGLASWSQLASTPRAPGSRDARWERREPALRGAKDRLTIGKHLDMGSPQLRTRDRGWPSPRPEREKRTSQSARRPTCTESRWKSEEEVESDDEYLALPARLTQVSSLVSYLGSISTLVTLPTGDIKGQSPLEVSDSDGPASFPSSSSQSQLPPGAALQGSGDPEGQNPCFLRSFVRAHDSAGEGSLGSSQALGVSSGLLKTRPSLPARLDRWPFSDPDVEGQLPRKGGEQGKESLVQCVKVMTLNVRKLCVQVSCLFPQSTNIIIKHVHVDQALFMCQAKKKKKKKKKKKKKKKKKKKKKKK

SEQ ID NO: 1837 - protein, 255 aa, Homo sapiens
MEPKRIREGYLVKKGSVFNTWKPMWVVLLEDGIEFYKKKSDNSPKGMIPLKGSTLTSPCQDFGKRMFVFKITTTKQQDHFFQAAFLEERDAWVRDIKKAIKCIEGGQKFARKSTRRSIRLPETIDLGALYLSMKDTEKGIKELNLEKDKKIFNHCFTGNCVIDWLVSNQSVRNRQEGLMIASSLLNEGYLQPAGDMSKSAVDGTAENPFLDNPDAFYYFPDSGFFCEENSSDDDVILKEEFRGVIIKQGCLLKQG

SEQ ID NO: 1838 - protein, 255 aa, Homo sapiens
MAMATKGGTVKAASGFNAMEDAQTLRKAMKGLGTDEDAIISVLAYRNTAQRQEIRTAYKSTIGRDLIDDLKSELSGNFEQVIVGMMTPTVLYDVQELRRAMKGAGTDEGCLIEILASRTPEEIRRISQTYQQQYGRSLEDDIRSDTSFMFQRVLVSLSAGGRDEGNYLDDALVRQDAQDLYEAGEKKWGTDEVKFLTVLCSRNRNHLLHVFDEYKRISQKDIEQSIKSETSGSFEDALLAIVKCMRNKSAYFAEK

SEQ ID NO: 1839 - protein, 221 aa, Homo sapiens
MAAAVRMNIQMLLEAADYLERREREAEHGYASMLPYNNKDRDALKRRNKSKKNNSSSRSTHNEMEKNRRAHLRLCLEKLKGLVPLGPESSRHTTLSLLTKAKLHIKKLEDCDRKAVHQIDQLQREQRHLKRQLEKLGIERIRMDSIGSTVSSERSDSDREEIDVDVESTDYLTGDLDWSSSSVSDSDERGSMQSLGSDEGYSSTSIKRIKLQDSHKACLGL

SEQ ID NO: 1840 - protein, 255 aa, Homo sapiens
MRTRTGSQLAAREVTGSGAVPRQLEGRRCQAGRDANGGTSSDGSSSMAAIYGGVEGGGTRSEVLLVSEDGKILAEADGLSTNHWLIGTDKCVERINEMVNRAKRKAGVDPLVPLRSLGLSLSGGDQEDAGRILIEELRDRFPYLSESYLITTDAAGSIATATPDGGVVLISGTGSNCRLINPDGSESGCGGWGHMMGDEGSAYWIAHQAVKIVFDSIDNLEAAPHDIGYVKQAMFHYFQVPDRLGILTHLYRDFD

SEQ ID NO: 1841 - protein, 255 aa, Homo sapiens
MAASMCDVFSFCVGVAGRARVSVEVRFVSSAKGKGLFATQLIRKGETIFVERPLVAAQFLWNALYRYRACDHCLRALEKAEENAQRLTGKPGQVLPHPELCTVRKDLHQNCPHCQVMYCSAECRLAATEQYHQVLCPGPSQDDPLHPLNKLQEAWRSIHYPPETASIMLMARMVATVKQAKDKDRWIRLFSQFCNKTANEEEEIVHKLLGDKFKGQLELLRRLFTEALYEEAVSQWFTPDGFRSLFALVGTNGQG

SEQ ID NO: 1842 - protein, 350 aa, Homo sapiens
MAATSLMSALAARLLQPAHSCSLRLRPFHLAAVRNEAVVISGRKLAQQIKQEVRQEVEEWVASGNKRPHLSVILVGENPASHSYVLNKTRAAAVVGINSETIMKPASISEEELLNLINKLNNDDNVDGLLVQLPLPEHIDERRICNAVSPDKDVDGFHVINVGRMCLDQYSMLPATPWGVWEIIKRTGIPTLGKNVVVAGRSKNVGMPIAMLLHTDGAHERPGGDATVTISHRYTPKEQLKKHTILADIVISAAGIPNLITADMIKEGAAVIDVGINRVHDPVTAKPKLVGDVDFEGVRQKAGYITPVPGGVGPMTVAMLMKNTIIAAKKVLRLEEREVLKSKELGVATN

SEQ ID NO: 1843 - protein, 255 aa, Homo sapiens
MAPIPKTVGRIKLDCSLRPSCPLEVAAAPKLCKEFGPEDYGEEDIVDFLRRLVESDPQGLHRIHVDGSSGRLQLWHHDYLLGHLDDEGKSTGQSDRGKGAEGLGTYCGLRKSFLYPPQESEPCPQSPSASATFPSVSDSLLQVAMPQKLLVTEEEANRLAEELVAEEERMKQKAEKKRLKKKRQKERKRQERLEQYCGEPKASTTSDGDESPPSSPGNPVQGQCGEEEDSLDLSSTFVSLALRKVGDWPLSARRE

SEQ ID NO: 1844 - protein, 255 aa, Homo sapiens
MPASAARPRPGPGQPTASPFPLLLLAVLSGPVSGRVPRSVPRTSLPISEADSCLTRFAVPHTYNYSVLLVDPASHTLYVGARDTIFALSLPFSGERPRRIDWMVPEAHRQNCRKKGKKEDECHNFVQILAIANASHLLTCGTFAFDPKCGVIDVSRFQQVERLESGRGKCPFEPAQRSAAVMAGGVLYAATVKNYLGTEPIITRAVGRAEDWIRTDTLPSWLNAPAFVAAVALSPAEWGDEDGDDEIYFFFTETS

SEQ ID NO: 1845 - protein, 44 aa, Homo sapiens
MADKPDMGEIASFDKAKLKKTETQEKNTLPTKETIEQEKRSEIS

SEQ ID NO: 1846 - protein, 175 aa, Homo sapiens
MYASSYPPPPQLSPRSHLCPPPPHPTPPQLNNLLLLEGRKSSLPSVAPTGSASAAEDSDLLTQPWYSGNCDRYAVESALLHLQKDGAYTVRPSSGPHGSQPFTLAVLLRGRVFNIPIRRLDGGRHYALGREGRNREELFSSVAAMVQHFMWHPLPLVDRHSGSRELTCLLFPTKP

SEQ ID NO: 1847 - protein, 145 aa, Homo sapiens
MATWALLLLAAMLLGNPGLVFSRLSPEYYDLARAHLRDEEKSCPCLAQEGPQGDLLTKTQELGRDYRTCLTIVQKLKKMVDKPTQRSVSNAATRVCRTGRSRWRDVCRNFMRRYQSRVTQGLVAGETAQQICEDLRLCIPSTGPL

SEQ ID NO: 1848 - protein, 255 aa, Homo sapiens
MQPAKEVTKASDGSLLGDLGHTPLSKKEGIKWQRPRLSRQALMRCCLVKWILSSTAPQGSDSSDSELELSTVRHQPEGLDQLQAQTKFTKKELQSLYRGFKNECPTGLVDEDTFKLIYAQFFPQGDATTYAHFLFNAFDADGNGAIHFEDFVVGLSILLRGTVHEKLKWAFNLYDINKDGYITKEEMLAIMKSIYDMMGRHTYPILREDAPAEHVERFFEKMDRNQDGVVTIEEFLEACQKDENIMSSMQLFENV

SEQ ID NO: 1849 - protein, 255 aa, Homo sapiens
MAPVGGGGRPVGGPARGRLLLAAPVLLVLLWALGARGQGSPQQGTIVGMRLASCNKSCGTNPDGIIFVSEGSTVNLRLYGYSLGNISSNLISFTEVDDAETLHKSTSCLELTKDLVVQQLVNVSRGNTSGVLVVLTKFLRRSESMKLYALCTRAQPDGPWLKWTDKDSLLFMVEEPGRFLPLWLHILLITVLLVLSGIFSGLNLGLMALDPMELRIVQNCGTEKERRYARKIEPIRRKGNYLLCSLLLGNVLVNT

SEQ ID NO: 1850 - protein, 255 aa, Homo sapiens
MAAAVAAAGRLGWLFAALCLGNAAGEAAPGPRVLGFCLEEDGAAGAGWVRGGAARDTPDATFLLRLFGPGFANSSWSWVAPEGAGCREEAASPAGEWRALLRLRLRAEAVRPHSALLAVRVEPGGGAAEEAAPPWALGLGAAGLLALAALARGLQLSALALAPAEVQVLRESGSEAERAAARRLEPARRWAGCALGALLLLASLAQAALAVLLYRAAGQRAVPAVLGSAGLVFLVGEVVPAAVSGRWTLALAPRA

SEQ ID NO: 1851 - protein, 255 aa, Homo sapiens
MPMDTSVYESPYSDPEELKDKKLFLKRDNLLIADIELGCGNFGSVRQGVYRMRKKQIDVAIKVLKQGTEKADTEEMMREAQIMHQLDNPYIVRLIGVCQAEALMLVMEMAGGGPLHKFLVGKREEIPVSNVAELLHQVSMGMKYLEEKNFVHRDLAARNVLLVNRHYAKISDFGLSKALGADDSYYTARSAGKWPLKWYAPECINFRKFSSRSDVWSYGVTMWEALSYGQKPYKKMKGPEVMAFIEQGKRMECPP

SEQ ID NO: 1852 - protein, 255 aa, Homo sapiens
MLIPFSMKNCFQLLCNCQVPAAGFKKTVKNGLILQSISNDVYQNLAVEDWIHDHMNLEGKPILFFWQNSPSVVIGRHQNPWQECNLNLMREEGIKLARRRSGGGTVYHDMGNINLTFFTTKKKYDRMENLKLIVRALNAVQPQLDVQATKRFDLLLDGQFKISGTASKIGRTTAYHHCTLLCSTDGTFLSSLLKSPYQGIRSNATASIPSLVKNLLEKDPTLTCEVLMNAVATEYAAYHQIDNHIHLINPTDETL

SEQ ID NO: 1853 - protein, 255 aa, Homo sapiens
MANDSPAKSLVDIDLSSLRDPAGIFELVEVVGNGTYGQVYKGRHVKTGQLAAIKVMDVTEDEEEEIKLEINMLKKYSHHRNIATYYGAFIKKSPPGHDDQLWLVMEFCGAGSITDLVKNTKGNTLKEDWIAYISREILRGLAHLHIHHVIHRDIKGQNVLLTENAEVKLVDFGVSAQLDRTVGRRNTFIGTPYWMAPEVIACDENPDATYDYRSDLWSCGITAIEMAEGAPPLCDMHPMRALFLIPRNPPPRLKS

SEQ ID NO: 1854 - protein, 255 aa, Homo sapiens
MLRLYVLVMGVSAFTLQPAAHTGAARSCRFRGRHYKREFRLEGEPVALRCPQVPYWLWASVSPRINLTWHKNDSARTVPGEEETRMWAQDGALWLLPALQEDSGTYVCTTRNASYCDKMSIELRVFENTDAFLPFISYPQILTLSTSGVLVCPDLSEFTRDKTDVKIQWYKDSLLLDKDNEKFLSVRGTTHLLVHDVALEDAGYYRCVLTFAHEGQQYNITRSIELRIKKKKEETIPVIISPLKTISASLGSRLT

SEQ ID NO: 1855 - protein, 255 aa, Homo sapiens
MKVLLRLICFIALLISSLEADKCKEREEKIILVSSANEIDVRPCPLNPNEHKGTITWYKDDSKTPVSTEQASRIHQHKEKLWFVPAKVEDSGHYYCVVRNSSYCLRIKISAKFVENEPNLCYNAQAIFKQKLPVAGDGGLVCPYMEFFKNENNELPKLQWYKDCKPLLLDNIHFSGVKDRLIVMNVAEKHRGNYTCHASYTYLGKQYPITRVIEFITLEENKPTRPVIVSPANETMEVDLGSQIQLICNVTGQLS

SEQ ID NO: 1856 - protein, 255 aa, Homo sapiens
MNCRELPLTLWVLISVSTAESCTSRPHITVVEGEPFYLKHCSCSLAHEIETTTKSWYKSSGSQEHVELNPRSSSRIALHDCVLEFWPVELNDTGSYFFQMKNYTQKWKLNVIRRNKHSCFTERQVTSKIVEVKKFFQITCENSYYQTLVNSTSLYKNCKKLLLENNKNPTIKKNAEFEDQGYYSCVHFLHHNGKLFNITKTFNITIVEDRSNIVPVLLGPKLNHVAVELGKNVRLNCSALLNEEDVIYWMFGEEN

SEQ ID NO: 1857 - protein, 255 aa, Homo sapiens
MDPGSRWRNLPSGPSLKHLTDPSYGIPREQQKAALQELTRAHVESFNYAVHEGLGLAVQAIPPFEFAFKDERISFTILDAVISPPTVPKGTICKEANVYPAECRGRRSTYRGKLTADINWAVNGISKGIIKQFLGYVPIMVKSKLCNLRNLPPQALIEHHEEAEEMGGYFIINGIEKVIRMLIMPRRNFPIAMIRPKWKTRGPGYTQYGVSMHCVREEHSAVNMNLHYLENGTVMLNFIYRKELFFLPLGFALKA

SEQ ID NO: 1858 - protein, 110 aa, Homo sapiens
MQAALEVTARYCGRELEQYGQCVAAKPESWQRDCHYLKMSIAQCTSSHPIIRQIRQACAQPFEAFEECLRQNEAAVGNCAEHMRRFLQCAEQVQPPRSPATVEAQPLPAS

SEQ ID NO: 1859 - protein, 159 aa, Homo sapiens
MALETICRPSGRKSSKMQAFRIWDVNQKTFYLRNNQLVAGYLQGPNVNLEEKIDVVPIEPHALFLGIHGGKMCLSCVKSGDETRLQLEAVNITDLSENRKQDKRFAFIRSDSGPTTSFESAACPGWFLCTAMEADQPVSLTNMPDEGVMVTKFYFQEDE

SEQ ID NO: 1860 - protein, 255 aa, Homo sapiens
MMGDYRLPDHPQPMEILNLYLGDSLEPHPGECPRETCSHEDPPEPFEEQTWATDPPEPTRQNVPPWGSGVELTHLGSWVHQDGLEPCQEQTRATDPPESTRQDAPPWGSGVELTHLGSPSAQREHRQNTASPGSPVNSHLPGSPKQNRSTSTQVVFWAGILQAQMCVLDLEEELEKTEGLKAGLKCCLPTPPVDLPGDTGLHSSPPENEDSGEDSSEPEGEGQAWLREGTPDSSPQWGAEEESMFFSNPLFLASP

SEQ ID NO: 1861 - protein, 255 aa, Homo sapiens
MSHLPMKLLRKKIEKRNLKLRQRNLKFQGASNLTLSETQNGDVSEETMGSRKVKKSKQKPMNVGLSETQNGGMSQEAVGNIKVTKSPQKSTVLTNGEAAMQSSNSESKKKKKKKRKMVNDAEPDTKKAKTENKGKSEEESAETTKETENNVEKPDNDEDESEVPSLPLGLTGAFEDTSFASLCNLVNENTLKAIKEMGFTNMTEIQHKSIRPLLEGRDLLAAAKTGSGKTLAFLIPAVELIVKLRFMPRNGTGVL

SEQ ID NO: 1862 - protein, 225 aa, Homo sapiens
MAEGETESPGPKKCGPYISSVTSQSVNLMIRGVVLFFIGVFLALVLNLLQIQRNVTLFPPDVIASIFSSAWWVPPCCGTASAVIGLLYPCIDRHLGEPHKFKREWSSVMRCVAVFVGINHASAKVDFDNNIQLSLTLAALSIGLWWTFDRSRSGFGLGVGIAFLATVVTQLLVYNGVYQYTSPDFLYVRSWLPCIFFAGGITMGNIGRQLAMYECKVIAEKSHQE

SEQ ID NO: 1863 - protein, 255 aa, Homo sapiens
MAGPLWRTAAFVQRHRTGLLVGSCAGLFGVPISYHLFPDPVVQWLYQYWPQGQPAPLPPQLQSLFQEVLQDIGVPSGHCYKPFTTFTFQPVSAGFPRLPAGAVVGIPASFLGDLVINTNHPVVIHGHTVDWRSPAGARLRASLTLSREAQKFALAREVVYLESSTTAVHALLAPACLAGTWALGVGAKYTLGLHAGPMNLRAAFSLVAAVAGFVAYAFSQDSLTHAVESWLDRRTASLSAAYACGGVEFYEKLLS

SEQ ID NO: 1864 - protein, 206 aa, Homo sapiens
MAANKSKGQSSLALHKVIMVGSGGVGKSALTLQFMYDEFVEDYEPTKADSYRKKVVLDGEEVQIDILDTAGQEDYAAIRDNYFRSGEGFLLVFSITEHESFTATAEFREQILRVKAEEDKIPLLVVGNKSDLEERRQVPVEEARSKAEEWGVQYVETSAKTRANVDKVFFDLMREIRTKKMSENKDKNGKKSSKNKKSFKERCCLL

SEQ ID NO: 1865 - protein, 255 aa, Homo sapiens
MWQLTSLLLFVATWGISGTPAPLDSVFSSSERAHQVLRIRKRANSFLEELRHSSLERECIEEICDFEEAKEIFQNVDDTLAFWSKHVDGDQCLVLPLEHPCASLCCGHGTCIDGIGSFSCDCRSGWEGRFCQREVSFLNCSLDNGGCTHYCLEEVGWRRCSCAPGYKLGDDLLQCHPAVKFPCGRPWKRMEKKRSHLKRDTEDQEDQVDPRLIDGKMTRRGDSPWQVVLLDSKKKLACGAVLIHPSWVLTAAHCM

SEQ ID NO: 1866 - protein, 255 aa, Homo sapiens
MSKRSWWAGSRKPPREMLKLSGSDSSQSMNGLEVAPPGLITNFSLATAEQCGQETPLENMLFASFYLLDFILALVGNTLALWLFIRDHKSGTPANVFLMHLAVADLSCVLVLPTRLVYHFSGNHWPFGEIACRLTGFLFYLNMYASIYFLTCISADRFLAIVHPVKSLKLRRPLYAHLACAFLWVVVAVAMAPLLVSPQTVQTNHTVVCLQLYREKASHHALVSLAVAFTFPFITTVTCYLLIIRSLRQGLRVEK

SEQ ID NO: 1867 - protein, 255 aa, Homo sapiens
MLRREARLRREYLYRKAREEAQRSAQERKERLRRALEENRLIPTELRREALALQGSLEFDDAGGEGVTSHVDDEYRWAGVEDPKVMITTSRDPSSRLKMFAKELKLVFPGAQRMNRGRHEVGALVRACKANGVTDLLVVHEHRGTPVGLIVSHLPFGPTAYFTLCNVVMRHDIPDLGTMSEAKPHLITHGFSSRLGKRVSDILRYLFPVPKDDSHRVITFANQDDYISFRHHVYKKTDHRNVELTEVGPRFELKL

SEQ ID NO: 1868 - protein, 255 aa, Homo sapiens
MELKRGKTFIKSSLQVSHEKPPDPAAVAAAREGTGPWSVLPGGQQRPHSEKGPQASPSAQEYDRCPNKGAQLDPKGGPAALCGATFKPVRKCKTHDSMSGAGRATAATGQLVGSASFPGSPGSRRMIDYRHFVPQMPFVPAVAKSIPRKRISLKRPKKCFRNLFHIRRNKTEDLASLAAEGKSLPSPGDPSDPGGRRSKAFLPPGEGPGLDGLCQDLLDSELLADASFGLCRALCEDVASLQSFDSLTGCGEVFA

SEQ ID NO: 1869 - protein, 255 aa, Homo sapiens
MGAAAKLAFAVFLISCSSGAILGRSETQECLFFNANWEKDRTNQTGVEPCYGDKDKRRHCFATWKNISGSIEIVKQGCWLDDINCYDRTDCVEKKDSPEVYFCCCEGNMCNEKFSYFPEMEVTQPTSNPVTPKPPYYNILLYSLVPLMLIAGIVICAFWVYRHHKMAYPPVLVPTQDPGPPPPSPLLGLKPLQLLEVKARGRFGCVWKAQLLNEYVAVKIFPIQDKQSWQNEYEVYSLPGMKHENILQFIGAEKR

SEQ ID NO: 1870 - protein, 255 aa, Homo sapiens
MNGGKECDGGDKEGGLPAIQVPVGWQRRVDQNGVLYVSPSGSLLSCLEQVKTYLLTDGTCKCGLECPLILPKVFNFDPGAAVKQRTAEDVKADEDVTKLCIHKRKIIAVATLHKSMEAPHPSLVLTSPGGGTNATPVVPSRAATPRSVRNKSHEGITNSVMPECKNPFKLMIGSSNAMGRLYVQELPGSQQQELHPVYPRQRLGSSEHGQKSPFRGSHGGLPSPASSGSQIYGDGSISPRTDPLGSPDVFTRSNP

SEQ ID NO: 1871 - protein, 207 aa, Homo sapiens
MLLITLSANLFTVPERSLTTTFSFSRYKSSDRPAHKVSMLLLCHALAIAVVQIVIFSESWAFAKNINFYNVRPPLDPTPFPNSFKCFTCENAGDNYNCNRWAEDKWCPQNTQYCLTVHHFTSHGRSTSITKKCASRSECHFVGCHHSRDSEHTECRSCCEGMICNVELPTNHTNAVFAVMHAQRTSGSSAPTLYLPVLAWVFVLPLL

SEQ ID NO: 1872 - protein, 255 aa, Homo sapiens
MEIKDQGAQMEPLLPTRNDEEAVVDRGGTRSILKTHFEKEDLEGHRTLFIGVHVPLGGRKSHRRHRHRGHKHRKRDRERDSGLEDGRESPSFDTPSQRVQFILGTEDDDEEHIPHDLFTELDEICWREGEDAEWRETARWLKFEEDVEDGGERWSKPYVATLSLHSLFELRSCILNGTVLLDMHANTLEEIADMVLDQQVSSGQLNEDVRHRVHEALMKQHHHQNQKKLTNRIPIVRSFADIGKKQSEPNSMDKN

SEQ ID NO: 1873 - protein, 255 aa, Homo sapiens
MAAAAAAAVGGQQPSQPELPAPGLALDKAATAAHLKAALSRPDNRAGAEELQALLERVLSAERPLAAAAGGEDAAAAGGGGGPGAAEEEALEWCKCLLAGGGGYDEFCAAVRAYDPAALCGLVWTANFVAYRCRTCGISPCMSLCAECFHQGDHTGHDFNMFRSQAGGACDCGDSNVMRESGFCKRHQIKSSSNIPCVPKDLLMMSEFVLPRFIFCLIQYLREGYNEPAADGPSEKDLNKVLQLLEPQISFLEDL

SEQ ID NO: 1874 - protein, 255 aa, Homo sapiens
MAGFGAMEKFLVEYKSAVEKKLAEYKCNTNTAIELKLVRFPEDLENDIRTFFPEYTHQLFGDDETAFGYKGLKILLYYIAGSLSTMFRVEYASKVDENFDCVEADDVEGKIRQIIPPGFCTNTNDFLSLLEKEVDFKPFGTLLHTYSVLSPTGGENFTFQIYKADMTCRGFREYHERLQTFLMWFIETASFIDVDDERWHYFLVFEKYNKDGATLFATVGYMTVYNYYVYPDKTRPRVSQMLILTPFQGQGHGAQ

SEQ ID NO: 1875 - protein, 255 aa, Homo sapiens
MAAAGQLCLLYLSAGLLSRLGAAFNLDTREDNVIRKYGDPGSLFGFSLAMHWQLQPEDKRLLLVGAPRAEALPLQRANRTGGLYSCDITARGPCTRIEFDNDADPTSESKEDQWMGVTVQSQGPGGKVVTCAHRYEKRQHVNTKQESRDIFGRCYVLSQNLRIEDDMDGGDWSFCDGRLRGHEKFGSCQQGVAATFTKDFHYIVFGAPGTYNWKGIVRVEQKNNTFFDMNIFEDGPYEVGGETEHDESLVPVPAN

SEQ ID NO: 1876 - protein, 255 aa, Homo sapiens
MSSLGASFVQIKFDDLQFFENCGGGSFGSVYRAKWISQDKEVAVKKLLKIEKEAEILSVLSHRNIIQFYGVILEPPNYGIVTEYASLGSLYDYINSNRSEEMDMDHIMTWATDVAKGMHYLHMEAPVKVIHRDLKSRNVVIAADGVLKICDFGASRFHNHTTHMSLVGTFPWMAPEVIQSLPVSETCDTYSYGVVLWEMLTREVPFKGLEGLQVAWLVVEKNERLTIPSSCPRSFAELLHQCWEADAKKRPSFKQ

SEQ ID NO: 1877 - protein, 255 aa, Homo sapiens
MSSDEKGISPAHKTSTPTHRSASSSTSSQRDSRQSIHILERTASSSTEPSVSRQLLEPEPVPLSKEADSWEIIEGLKIGQTNVQKPDKHEGFMLKKRKWPLKGWHKRFFVLDNGMLKYSKAPLDIQKGKVHGSIDVGLSVMSIKKKARRIDLDTEEHIYHLKVKSQDWFDAWVSKLRHHRLYRQNEIVRSPRDASFHIFPSTSTAESSPAANVSVMDGKMQPNSFPWQSPLPCSNSLPATCTTGQSKVAAWLQDS

SEQ ID NO: 1878 - protein, 255 aa, Homo sapiens
MEGVLYKWTNYLTGWQPRWFVLDNGILSYYDSQDDVCKGSKGSIKMAVCEIKVHSADNTRMELIIPGEQHFYMKAVNAAERQRWLVALGSSKACLTDTRTKKEKEISETSESLKTKMSELRLYCDLLMQQVHTIQEFVHHDENHSSPSAENMNEASSLLSATCNTFITTLEECVKIANAKFKPEMFQLHHPDPLVSPVSPSPVQMMKRSVSHPGSCSSERSSHSIKEPVSTLHRLSQRRRRTYSDTDSCSDIPLE

SEQ ID NO: 1879 - protein, 255 aa, Homo sapiens
MPPKKQAQAGGSKKAEQKKKEKIIEDKTFGLKNKKGAKQQKFIKAVTHQVKFGQQNPRQVAQSEAEKKLKKDDKKKELQELNELFKPVVAAQKISKGADPKSVVCAFFKQGQCTKGDKCKFSHDLTLERKCEKRSVYIDARDEELEKDTMDNWDEKKLEEVVNKKHGEAEKKKPKTQIVCKHFLEAIENNKYGWFWVCPGGGDICMYRHALPPGFVLKKDKKKEEKEDEISLEDLIERERSALGPNVTKITLESF

SEQ ID NO: 1880 - protein, 255 aa, Homo sapiens
MMSFVQKGSWLLLALLHPTIILAQQEAVEGGCSHLGQSYADRDVWKPEPCQICVCDSGSVLCDDIICDDQELDCPNPEIPFGECCAVCPQPPTAPTRPPNGQGPQGPKGDPGPPGIPGRNGDPGIPGQPGSPGSPGPPGICESCPTGPQNYSPQYDSYDVKSGVAVGGLAGYPGPAGPPGPPGPPGTSGHPGSPGSPGYQGPPGEPGQAGPSGPPGPPGAIGPSGPAGKDGESGRPGRPGERGLPGPPGIKGPAG

SEQ ID NO: 1881 - protein, 255 aa, Homo sapiens
MMRLRGSGMLRDLLLRSPAGVSATLRRAQPLVTLCRRPRGGGRPAAGPAAAARLHPWWGGGGWPAEPLARGLSSSPSEILQELGKGSTHPQPGVSPPAAPAAPGPKDGPGETDAFGNSEGKELVASGENKIKQGLLPSLEDLLFYTIAEGQEKIPVHKFITALKSTGLRTSDPRLKECMDMLRLTLQTTSDGVMLDKDLFKKCVQSNIVLLTQAFRRKFVIPDFMSFTSHIDELYESAKKQSGGKVADYIPQLAK

SEQ ID NO: 1882 - protein, 124 aa, Homo sapiens
MWKGCLTLYTGRGGELQKIGEFCMVYSEVPNFSEPNPDYRGQQNKGAQSEQKNNSMNSNMGTGTFGPVGNGVHTGPESREHQFSHAGRSNGRGLINPQLQGTASNQTVMTTISNGRDPRRAFKR

SEQ ID NO: 1883 - protein, 238 aa, Homo sapiens
MAARTGHTALRRVVSGCRPKSATAAGAQAPVRNGRYLASCGILMSRTLPLHTSILPKEICARTFFKITAPLINKRKEYSERRILGYSMQEMYDVVSGVEDYKHFVPWCKKSDVISKRSGYCKTRLEIGFPPVLERYTSVVTLVKPHLVKASCTDGRLFNHLETIWRFSPGLPGYPRTCTLDFSISFEFRSLLHSQLATLFFDEVVKQMVAAFERRACKLYGPETNIPRELMLHEVHHT

SEQ ID NO: 1884 - protein, 255 aa, Homo sapiens
MLRTSVLRLLGRTGASRLSLLEDFGPRYYSSGSLSAGDDACDVRAYFTTPIFYVNAAPHIGHLYSALLADALCRHRRLRGPSTAATRFSTGTDEHGLKIQQAAATAGLAPTELCDRVSEQFQQLFQEAGISCTDFIRTTEARHRVAVQHFWGVLKSRGLLYKGVYEGWYCASDECFLPEAKVTQQPGPSGDSFPVSLESGHPVSWTKEENYIFRLSQFRKPLQRWLRGNPQAITPEPFHHVVLQWLDEELPDLSV

SEQ ID NO: 1885 - protein, 255 aa, Homo sapiens
MAEIGEDLDKSDVSSLIFLMKDYMGRGKISKEKSFLDLVVELEKLNLVAPDQLDLLEKCLKNIHRIDLKTKIQKYKQSVQGAGTSYRNVLQAAIQKSLKDPSNNFRLHNGRSKEQRLKEQLGAQQEPVKKSIQESEAFLPQSIPEERYKMKSKPLGICLIIDCIGNETELLRDTFTSLGYEVQKFLHLSMHGISQILGQFACMPEHRDYDSFVCVLVSRGGSQSVYGVDQTHSGLPLHHIRRMFMGDSCPYLAGK

SEQ ID NO: 1886 - protein, 255 aa, Homo sapiens
MLVLFETSVGYAIFKVLNEKKLQEVDSLWKEFETPEKANKIVKLKHFEKFQDTAEALAAFTALMEGKINKQLKKVLKKIVKEAHEPLAVADAKLGGVIKEKLNLSCIHSPVVNELMRGIRSQMDGLIPGVEPREMAAMCLGLAHSLSRYRLKFSADKVDTMIVQAISLLDDLDKELNNYIMRCREWYGWHFPELGKIISDNLTYCKCLQKVGDRKNYASAKLSELLPEEVEAEVKAAAEISMGTEVSEEDICNIL

SEQ ID NO: 1887 - protein, 255 aa, Homo sapiens
MSQRVRRNGSPTPAGSLGGGAVATAGGPGSRLQPMRATVPFQLKQQQQQQHGSPTRSGGGGGGNNNGGCCGGASGPAGGGGGGGPRTASRSTSPTRGGGNAAARTSPTVATQTGASATSTRGTSPTRSAAPGARGSPPRPPPPPPLLGTVSSPSSSPTHLWTGEVSAAPPPARVRHRRRSPEQSRSSPEKRSPSAPVCKAGDKTRQPSSSPSSIIRRTSSLDTLAAPYLAGHWPRDSHGQAAPCMRDKATQTESA

SEQ ID NO: 1888 - protein, 255 aa, Homo sapiens
MLDFAIFAVTFLLALVGAVLYLYPASRQAAGIPGITPTEEKDGNLPDIVNSGSLHEFLVNLHERYGPVVSFWFGRRLVVSLGTVDVLKQHINPNKTSDPFETMLKSLLRYQSGGGSVSENHMRKKLYENGVTDSLKSNFALLLKLSEELLDKWLSYPETQHVPLSQHMLGFAMKSVTQMVMGSTFEDDQEVIRFQKNHGTVWSEIGKGFLDGSLDKNMTRKKQYEDALMQLESVLRNIIKERKGRNFSQHIFIDS

SEQ ID NO: 1889 - protein, 255 aa, Homo sapiens
MLTTLKPFGSVSVESKMNNKAGSFFWNLRQFSTLVSTSRTMRLCCLGLCKPKIVHSNWNILNNFHNRMQSTDIIRYLFQDAFIFKSDVGFQTKGISTLTALRIERLLYAKRLFFDSKQSLVPVDKSDDELKKVNLNHEVSNEDVLTKETKPNRISSRKLSEECNSLSDVLDAFSKAPTFPSSNYFTAMWTIAKRLSDDQKRFEKRLMFSHPAFNQLCEHMMREAKIMQYKYLLFSLHAIVKLGIPQNTILVQTLL

SEQ ID NO: 1890 - protein, 255 aa, Homo sapiens
MATDDKTSPTLDSANDLPRSPTSPSHLTHFKPLTPDQDEPPFKSAYSSFVNLFRFNKERAEGGQGEQQPLSGSWTSPQLPSRTQSVRSPTPYKKQLNEELQRRSSALDTRRKAEPTFGGHDPRTAVQLRSLSTVLKRLKEIMEGKSQDSDLKQYWMPDSQCKECYDCSEKFTTFRRRHHCRLCGQIFCSRCCNQEIPGKFMGYTGDLRACTYCRKIALSYAHSTDSNSIGEDLNALSDSACSVSVLDPSEPRTPV

SEQ ID NO: 1891 - protein, 387 aa, Homo sapiens
MSSKVYSTGSRAKDHQPSGPECLPLPEANAEAIDFLSSLHKEELQMLFFSETLAMVSDTGEPQGELTIEVQRGKYQEKLGMLTYCLFVHASSRGFLDKMLCGNSLLGYLSEKLELMEQHSQDFIKFLILPMERKMSLLKQDDQLAVTRSIKEGEEVKTGVTSFPWSSIKGFISEAANLVLLRVMAWRRMVPSNARFLTLDTEGKLCYLTYQNLGFQTIQVDHQQAEVFIVEQTVHAEEGIPMSCQYYLLSDGHLAKRIQVGSPGCCIITKMPILREEDEIEPRPVFEKKPLVWEEDMELYSKFLDRKEELRLGHASYLRQHPEAHALISDFLLFLLLRQPEDVVTFAAEFFGPFDPWRPSSPALGSSHRPNPFRSLEPEGDARSGAA

SEQ ID NO: 1892 - protein, 255 aa, Homo sapiens
MTGDKGPQRLSGSSYGSISSPTSPTSPGPQQAPPRETYLSEKIPIPDTKPGTFSLRKLWAFTGPGFLMSIAFLDPGNIESDLQAGAVAGFKLLWVLLWATVLGLLCQRLAARLGVVTGKDLGEVCHLYYPKVPRTVLWLTIELAIVGSDMQEVIGTAIAFNLLSAGRIPLWGGVLITIVDTFFFLFLDNYGLRKLEAFFGLLITIMALTFGYEYVVARPEQGALLRGLFLPSCPGCGHPELLQAVGIVGAIIMPH

SEQ ID NO: 1893 - protein, 255 aa, Homo sapiens
MAASAKRKQEEKHLKMLRDMTGLPHNRKCFDCDQRGPTYVNMTVGSFVCTSCSGSLRGLNPPHRVKSISMTTFTQQEIEFLQKHGNEVCKQIWLGLFDDRSSAIPDFRDPQKVKEFLQEKYEKKRWYVPPEQAKVVASVHASISGSSASSTSSTPEVKPLKSLLGDSAPTLHLNKGTPSQSPVVGRSQGQQQEKKQFDLLSDLGSDIFAAPAPQSTATANFANFAHFNSHAAQNSANADFANFDAFGQSSGSSNF

SEQ ID NO: 1894 - protein, 255 aa, Homo sapiens
MHGGQGPLLLLLLLAVCLGAQGRNQEERLLADLMQNYDPNLRPAERDSDVVNVSLKLTLTNLISLNEREEALTTNVWIEMQWCDYRLRWDPRDYEGLWVLRVPSTMVWRPDIVLENNVDGVFEVALYCNVLVSPDGCIYWLPPAIFRSACSISVTYFPFDWQNCSLIFQSQTYSTNEIDLQLSQEDGQTIEWIFIDPEAFTENGEWAIQHRPAKMLLDPAAPAQEAGHQKVVFYLLIQRKPLFYVINIIAPCVLI

SEQ ID NO: 1895 - protein, 255 aa, Homo sapiens
MASKCSSERKSRTSLTLNQKLEMIKLSEEGMSKAEIGRRLGLLRQTVSQVVNAKEKFLKEVKSATPMNTRMIRKRNSLIADMEKVLVVWIEDQTSRNIPLSQSLIQNKALTLFNSMKAERGVEAAEEKFEASRGWFMRFKERSHFHNIKAQGEAASADVEAAASYPEALAKIIDEGGYTKQQIFNVDETAFYWKKMPSRTFIAREEKSVPGFKASKDRLTLLLGANAAGDFKLKPMLIYHSENPRALKNYTKSTL

SEQ ID NO: 1896 - protein, 255 aa, Homo sapiens
MSFRAARLSMRNRRNDTLDSTRTLYSSASRSTDLSYSESDLVNFIQANFKKRECVFFTKDSKATENVCKCGYAQSQHMEGTQINQSEKWNYKKHTKEFPTDAFGDIQFETLGKKGKYIRLSCDTDAEILYELLTQHWHLKTPNLVISVTGGAKNFALKPRMRKIFSRLIYIAQSKGAWILTGGTHYGLMKYIGEVVRDNTISRSSEENIVAIGIAAWGMVSNRDTLIRNCDAEGYFLAQYLMDDFTRDPLYILDN

SEQ ID NO: 1897 - protein, 255 aa, Homo sapiens
MDMGTQGSGRKRLPNRERLTAEDDALNQIAREAEARLAAKRAARAEAREIRMKELERQQKEIYQVQKKYYGLDTKWGDIEQWMEDSERYSRRSRRNTSASDEDERMSVGSRGSLRSQPDLEYGGPYAWTNGYDGELYGSQSLNRRSGRPSCLYSAARPSGSYRASVLDEGSFGGTRRGSTSGSRAPSEYSGHLNSSSRASSRASSARASPVVEERPEKDFTEKGSRNMPGLSAATLASLGGTSSRRGSGDTSISI

SEQ ID NO: 1898 - protein, 255 aa, Homo sapiens
MMSMLGGLQRYFRVILLLLLALTLLLLAGFLHSDLELDTPLFGGQAEGPPVTNIMFLKTHKTASSTVLNILYRFAETHNLSVALPAGSRVHLGYPWLFLARYVEGVGSQQRFNIMCNHLRFNLPQVQKVMPNDTFYFSILRNPVFQLESSFIYYKTYAPAFRGAPSLDAFLASPRTFYNDSRHLRNVYAKNNMWFDFGFDPNAQCEEGYVRARIAEVERRFRLVLIAEHLDESLVLLRRRLRWALDDVVAFRLNS

SEQ ID NO: 1899 - protein, 140 aa, Homo sapiens
MPSAFSVSSFPVSIPAVLTQTDWTEPWLMGLATFHALCVLLTCLSSRSYRLQIGHFLCLVILVYCAEYINEAAAMNWRLFSKYQYFDSRGMFISIVFSAPLLVNAMIIVVMWVWKTLNVMTDLKNAQERRKEKKRRRKED

SEQ ID NO: 1900 - protein, 233 aa, Homo sapiens
MVSMSFKRNRSDRFYSTRCCGCCHVRTGTIILGTWYMVVNLLMAILLTVEVTHPNSMPAVNIQYEVIGNYYSSERMADNACVLFAVSVLMFIISSMLVYGAISYQVGWLIPFFCYRLFDFVLSCLVAISSLTYLPRIKEYLDQLPDFPYKDDLLALDSSCLLFIVLVFFALFIIFKAYLINCVWNCYKYINNRNVPEIAVYPAFEAPPQYVLPTYEMAVKMPEKEPPPPYLPA

SEQ ID NO: 1901 - protein, 125 aa, Homo sapiens
MAMQAAKRANIRLPPEVNRILYIRNLPYKITAEEMYDIFGKYGPIRQIRVGNTPETRGTAYVVYEDIFDAKNACDHLSGFNVCNRYLVVLYYNANRAFQKMDTKKKEEQLKLLKEKYGINTDPPK

SEQ ID NO: 1902 - protein, 255 aa, Homo sapiens
MLAVHFDKPGGPENLYVKEVAKPSPGEGEVLLKVAASALNRADLMQRQGQYDPPPGASNILGLEASGHVAELGPGCQGHWKIGDTAMALLPGGGQAQYVTVPEGLLMPIPEGLTLTQAAAIPEAWLTAFQLLHLVGNVQAGDYVLIHAGLSGVGTAAIQLTRMAGAIPLVTAGSQKKLQMAEKLGAAAGFNYKKEDFSEATLKFTKGAGVNLILDCIGGSYWEKNVNCLALDGRWVLYGLMGGGDINGPLFSKLL

SEQ ID NO: 1903 - protein, 100 aa, Homo sapiens
MGNNCYFKSLGAVILPSASATFVVLCVASVPPLILLSFLSLFPPSFPSVFLRSKGYNGGANCLAISDKTSLSDCSAHDLPCSLTGSGIRSHQLSAGHLGL

SEQ ID NO: 1904 - protein, 255 aa, Homo sapiens
MVCSAAPLLLLATTLPLLGSPVAQASQPGQSQAGGESGSGQLLDQENGAGESALVSVYVHLDFPDKTWPPELSRTLTLPAASASSSPRPLLTGLRLTTECNVNHKGNFYCACLSGYQWNTSICLHYPPCQSLHNHQPCGCLVFSHPEPGYCQLLPPGSPVTCLPAVPGILNLNSQLQMPGDTLSLTLHLSQEATNLSWFLRHPGSPSPILLQPGTQVSVTSSHGQAALSVSNMSHHWAGEYMSCFEAQGFKWNLY

SEQ ID NO: 1905 - protein, 176 aa, Homo sapiens
MALWRAYQRALAAHPWKVQVLTAGSLMGLGDIISQQLVERRGLQEHQRGRTLTMVSLGCGFVGPVVGGWYKVLDRFIPGTTKVDALKKMLLDQGGFAPCFLGCFLPLVGALNGLSAQDNWAKLQRDYPDALITNYYLWPAVQLANFYLVPLHYRLAVVQCVAVIWNSYLSWKAHRL

SEQ ID NO: 1906 - protein, 255 aa, Homo sapiens
MGAYLSQPNTVKCSGDGVGAPRLPLPYGFSAMQGWRVSMEDAHNCIPELDSETAMFSVYDGHGGEEVALYCAKYLPDIIKDQKAYKEGKLQKALEDAFLAIDAKLTTEEVIKELAQIAGRPTEDEDEKEKVADEDDVDNEEAALLHEEATMTIEELLTRYGQNCHKGPPHSKSGGGTGEEPGSQGLNGEAGPEDSTRETPSQENGPTAKAYTGFSSNSERGTEAGQVGEPGIPTGEAGPSCSSASDKLPRVAKSK

SEQ ID NO: 1907 - protein, 255 aa, Homo sapiens
MNFIKDNSRALIQRMGMTVIKQITDDLFVWNVLNREEVNIICCEKVEQDAARGIIHMILKKGSESCNLFLKSLKEWNYPLFQDLNGQSLFHQTSEGDLDDLAQDLKDLYHTPSFLNFYPLGEDIDIIFNLKSTFTEPVLWRKDQHHHRVEQLTLNGLLQALQSPCIIEGESGKGKSTLLQRIAMLWGSGKCKALTKFKFVFFLRLSRAQGGLFETLCDQLLDIPGTIRKQTFMAMLLKLRQRVLFLLDGYNEFKP

SEQ ID NO: 1908 - protein, 254 aa, Homo sapiens
MPAKTPIYLKAANNKKGKKFKLRDILSPDMISPPLGDFRHTIHIGKEGQHDVFGDISFLQGNYELLPGNQEKAHLGQFPGHNEFFRANSTSDSVFTETPSPVLKNAISLPTIGGSQALMLPLLSPVTFNSKQESFGPAKLPRLSCEPVMEEKAQEKSSLLENGTVHQGDTSWGSSGSASQSSQGRDSHSSSLSEQYPDWPAEDMFDHPTPCELIKGKTKSEESLSDLTGSLLSLQLDLGPSLLDEVLNVMDKNK

SEQ ID NO: 1909 - protein, 255 aa, Homo sapiens
MLARETYEEDREYESQAKRLKTEEGEIDYSAEEGENRREATPRGGGDGGGGGRSFSQPEAGGSHHKVSVSPVVHVRGLCESVVEADLVEALEKFGTICYVMMMPFKRQALVEFENIDSAKECVTFAADEPVYIAGQQAFFNYSTSKRITRPGNTDDPSGGNKVLLLSIQNPLYPITVDVLYTVCNPVGKVQRIVIFKRNGIQAMVEFESVLCAQKAKAALNGADIYAGCCTLKIEYARPTRLNVIRNDNDSWDYT

SEQ ID NO: 1910 - protein, 114 aa, Homo sapiens
MYYKFSGFTQKLAGAWASEAYSPQGLKPVVSTEAPPIIFATPTKLTSDSTVYDYAGKNKVPELQKFFQKADGVPVYLKRGLPDQMLYRTTMALTVGGTIYCLIALYMASQPKNK

SEQ ID NO: 1911 - protein, 255 aa, Homo sapiens
MTFGRSGAASVVLNVGGARYSLSRELLKDFPLRRVSRLHGCRSERDVLEVCDDYDRERNEYFFDRHSEAFGFILLYVRGHGKLRFAPRMCELSFYNEMIYWGLEGAHLEYCCQRRLDDRMSDTYTFYSADEPGVLGRDEARPGGAEAAPSRRWLERMRRTFEEPTSSLAAQILASVSVVFVIVSMVVLCASTLPDWRNAAADNRSLDDRSRYSAGPGREPSGIIEAICIGWFTAECIVRFIVSKNKCEFVKRPLN

SEQ ID NO: 1912 - protein, 149 aa, Homo sapiens [sequence omitted]

SEQ ID NO: 1913 - protein, 255 aa, Homo sapiens
MSRRKQGKPQHLSKREFSPEPLEAILTDDEPDHGPLGAPEGDHDLLTCGQCQMNFPLGDILIFIEHKRKQCNGSLCLEKAVDKPPSPSPIEMKKASNPVEVGIQVTPEDDDCLSTSSRGICPKQEHIADKLLHWRGLSSPRSAHGALIPTPGMSAEYAPQGICKDEPSSYTCTTCKQPFTSAWFLLQHAQNTHGLRIYLESEHGSPLTPRVGIPSGLGAECPSQPPLHGIHIADNNPFNLLRIPGSVSREASGLA

SEQ ID NO: 1914 - protein, 1071 aa, Homo sapiens
MPAIMTMLADHAARQLLDFSQKLDINLLDNVVNCLYHGEGAQQRMAQEVLTHLKEHPDAWTRVDTILEFSQNMNTKYYGLQILENVIKTRWKILPRNQCEGIKKYVVGLIIKTSSDPTCVEKEKVYIGKLNMILVQILKQEWPKHWPTFISDIVGASRTSESLCQNNMVILKLLSEEVFDFSSGQITQVKSKHLKDSMCNEFSQIFQLCQFVMENSQNAPLVHATLETLLRFLNWIPLGYIFETKLISTLIYKFLNVPMFRNVSLKCLTEIAGVSVSQYEEQFVTLFTLTMMQLKQMLPLNTNIRLAYSNGKDDEQNFIQNLSLFLCTFLKEHDQLIEKRLNLRETLMEALHYMLLVSEVEETEIFKICLEYWNHLAAELYRESPFSTSASPLLSGSQHFDVPPRRQLYLPMLFKVRLLMVSRMAKPEEVLVVENDQGEVVREFMKDTDSINLYKNMRETLVYLTHLDYVDTERIMTEKLHNQVNGTEWSWKNLNTLCWAIGSISGAMHEEDEKRFLVTVIKDLLGLCEQKRGKDNKAIIASNIMYIVGQYPRFLRAHWKFLKTVVNKLFEFMHETHDGVQDMACDTFIKIAQKCRRHFVQVQVGEVMPFIDEILNNINTIICDLQPQQVHTFYEAVGYMIGAQTDQTVQEHLIEKYMLLPNQVWDSIIQQATKNVDILKDPETVKQLGSILKTNVRACKAVGHPFVIQLGRIYLDMLNVYKCLSENISAAIQANGEMVTKQPLIRSMRTVKRETLKLISGWVSRSNDPQMVAENFVPPLLDAVLIDYQRNVPAAREPEVLSTMAIIVNKLGGHITAEIPQIFDAVFECTLNMINKDFEEYPEHRTNFFLLLQAVNSHCFPAFLAIPPTQFKLVLDSIIWAFKHTMRNVADTGLQILFTLLQNVAQEEAAAQSFYQTYFCDILQHIFSVVTDTSHTAGLTMHASILAYMFNLVEEGKISTSLNPGNPVNNQIFLQEYVANLLKSAFPHLQDAQVKLFVTGLFSLNQDIPAFKEHLRDFLVQIKEFAGEDTSDLFLEEREIALRQADEEKHKRQMSVPGIFNPHEIPEEMCD

SEQ ID NO: 1915 - protein, 227 aa, Homo sapiens
MAPYHIRKYQESDRKSVVGLLSRGMAEHAPATFRRLLKLPRTLILLLGGALALLLVSGSWILALVFSLSLLPALWFLAKKPWTRYVDIALRTDMSDITKSYLSECGSCFWVGESEEKVVGTVGALPVDDPTLREKRLQLFHLSVDNEHRGQGIAKALVRTVLQFARDQGYSEVVLDTSNIQLSAMGLYQSLGFKKTGQSFFHVWARLVDLHTVHFIYHLPSAQAGRL

SEQ ID NO: 1916 - protein, 255 aa, Homo sapiens
MRNSETLERGVGGCRVFSCLGSYPGIEGAGLALLADLALGGRLLGTHMSQWHHPRSGWGRRRDFSGRSSAKKKGGNHIPERWKDYLPVGQRMPGTRFIAFKVPLQKSFEKKLAPEECFSPLDLFNKIREQNEELGLIIDLTYTQRYYKPEDLPETVPYLKIFTVGHQVPDDETIFKFKHAVNGFLKENKDNDKLIGVHCTHGLNRTGYLICRYLIDVEGVRPDDAIELFNRCRGHCLERQNYIEDLQNGPIRKNW

SEQ ID NO: 1917 - protein, 255 aa, Homo sapiens
MARGERRRRAVPAEGVRTAERAARGGPGRRDGRGGGPRSTAGGVALAVVVLSLALGMSGRWVLAWYRARRAVTLHSAPPVLPADSSSPAVAPDLFWGTYRPHVYFGMKTRSPKPLLTGLMWAQQGTTPGTPKLRHTCEQGDGVGPYGWEFHDGLSFGRQHIQDGALRLTTEFVKRPGGQHGGDWSWRVTVEPQDSGTSALPLVSLFFYVVTDGKEVLLPEVGAKGQLKFISGHTSELGDFRFTLLPPTSPGDTAP

SEQ ID NO: 1918 - protein, 255 aa, Homo sapiens
MADVTARSLQYEYKANSNLVLQADRSLIDRTRRDEPTGEVLSLVGKLEGTRMGDKAQRTKPQMQEERRAKRRKRDEDRHDINKMKGYTLLSEGIDEMVGIIYKPKTKETRETYEVLLSFIQAALGDQPRDILCGAADEVLAVLKNEKLRDKERRKEIDLLLGQTDDTRYHVLVNLGKKITDYGGDKEIQNMDDNIDETYGVNVQFESDEEEGDEDVYGEVREEASDDDMEGDEAVVRCTLSANLVASGELMSSKK

SEQ ID NO: 1919 - protein, 255 aa, Homo sapiens
MAPHWAVWLLAARLWGLGIGAEVWWNLVPRKTVSSGELATVVRRFSQTGIQDFLTLTLTEPTGLLYVGAREALFAFSMEALELQGAISWEAPVEKKTECIQKGKNNQTECFNFIRFLQPYNASHLYVCGTYAFQPKCTYVNMLTFTLEHGEFEDGKGKCPYDPAKGHAGLLVDGELYSATLNNFLGTEPIILRNMGPHHSMKTEYLAFWLNEPHFVGSAYVPESVGSFTGDDDKVYFFFRERAVESDCYAEQVVA

SEQ ID NO: 1920 - protein, 255 aa, Homo sapiens; identical to SEQ ID NO: 1852

SEQ ID NO: 1921 - protein, 255 aa, Homo sapiens
MAKVPDMFEDLKNCYSENEEDSSSIDHLSLNQKSFYHVSYGPLHEGCMDQSVSLSISETSKTSKLTFKESMVVVATNGKVLKKRRLSLSQSITDDDLEAIANDSEEEIIKPRSAPFSFLSNVKYNFMRIIKYEFILNDALNQSIIRANDQYLTAAALHNLDEAVKFDMGAYKSSKDDAKITVILRISKTQLYVTAQDEDQPVLLKEMPEIPKTITGSETNLLFFWETHGTKNYFTSVAHPNLFIATKQDYWVCLA

SEQ ID NO: 1922 - protein, 255 aa, Homo sapiens
MVPPRRHRGAGRPGVLSSSPPFRLRSAKFSGIALEDLRRALKTRLQMVCVFVMNRMNSQNSGFTQRRRMALGIVILLLVDVIWVASSELTSYVFTQYNKPFFSTFAKTSMFVLYLLGFIIWKPWRQQCTRGLRGKHAAFFADAEGYFAACTTDTTMNSSLSEPLYVPVKFHDLPSEKPESTNIDTEKTPKKSRVRFSNIMEIRQLPSSHALEAKLSRMSYPVKEQESILKTVGKLTATQVAKISFFFCFVWFLAN

SEQ ID NO: 1923 - protein, 255 aa, Homo sapiens
MGLPRGPEGQGLPEVETREDEEQNVKLTEILELLVAAGYFRARIKGLSPFDKVVGGMTWCITTCNFDVDVDLLFQENSTIGQKIALSEKIVSVLPRMKCPHQLEPHQIQGMDFIHIFPVVQWLVKRAIETKEEMGDYIRSYSVSQFQKTYSLPEDDDFIKRKEKAIKTVVDLSEVYKPRRKYKRHQGAEELLDEESRIHATLLEYGRRYGFSRQSKMEKAEDKKTALPAGLSATEKADAHEEDELRAAEEQRIQS

SEQ ID NO: 1924 - protein, 1477 aa, Homo sapiens
MEPRMESCLAQVLQKDVGKRLQVGQELIDYFSDKQKSADLEHDQTMLDKLVDGLATSWVNSSNYKVVLLGMDILSALVTRLQDRFKAQIGTVLPSLIDRLGDAKDSVREQDQTLLLKIMDQAANPQYVWDRMLGGFKHKNFRTREGICLCLIATLNASGAQTLTLSKIVPHICNLLGDPNSQVRDAAINSLVEIYRHVGERVRADLSKKGLPQSRLNVIFTKFDEVQKSGNMIQSANDKNFDDEDSVDGNRPSSASSTSSKAPPSSRRNVGMGTTRRLGSSTLGSKSSAAKEGAGAVDEEDFIKAFDDVPVVQIYSSRDLEESINKIREILSDDKHDWEQRVNALKKIRSLLLAGAAEYDNFFQHLRLLDGAFKLSAKDLRSQVVREACITLGHLSSVLGNKFDHGAEAIMPTIFNLIPNSAKIMATSGVVAVRLIIRHTHIPRLIPVITSNCTSKSVAVRRRCFEFLDLLLQEWQTHSLERHISVLAETIKKGIHDADSEARIEARKCYWGFHSHFSREAEHLYHTLESSYQKALQSHLKNSDSIVSLPQSDRSSSSSQESLNRPLSAKRSPTGSTTSRASTVSTKSVSTTGSLQRSRSDIDVNAAASAKSKVSSSSGTTPFSSAAALPPGSYASLESRHMREDMEYIGLDSGRIRTRRQSSGSATNVASTPDNRGRSRAKVVSQSQPGSRSSSPGKLLGSGYGGLTGGSSRGPPVTPSSEKRSKIPRSQGCSRETSPNRIGLDRFGLGQPGRIPGSVNAMRVLSTSTDLEAAVADALLLGDSRSKKPVRRRYEPYGMYSDDDANSDASSVCSERSYGSRNGGIPHYLRQTEDVAEVLNHCASSNWSERKEGLLGLQNLLKSQRTLSRVELKRLCEIFTRMFADPHSKRVFSMFLETLVDFIIIHKDDLQDWLFVLLTQLLKKMGADLLGSVQAKVQKALDVTRDSFPFDQQFNILMRFIVDQTQTPNLKVKVAILKYIESLARQMDPTDFVNSSETRLAVSRIITWTTEPKSSDVRKAAQIVLISLFELNTPEFTMLLGALPKTFQDGATKLLHNHLKNSSNTSVGSPSNTIGRTPSRHTSSRTSPLTSPTNCSHGGLSPSMLDYDTENLNSEEIYSSLRGVTEAIEKFSFRSQEDLNEPIKRDGKKECDIVSRDGGAASPATEGRGGSEVEGGRTALDNKTSLLNTQPPRAFPGPRARDYNPYPYSDAINTYDKTALKEAVFDDDMEQLRDVPIDHSDLVADLLKELSNHNERVEERKGALLELLKITREDSLGVWEEHFKTILLLLLETLGDKDHSIRALALRVLREILRNQPARFKNYAELTIMKTLEAHKDSHKEVVRAAEEAASTLASSIHPEQCIKVLCPIIQTADYPINLAAIKMQTKVVERIAKESLLQLLVDIIPGLLQGYDNTESSVRKASVFCLVAIYSVIGEDLKPHLAQLTGSKMKLLNLYIKRAQTTNSNSSSSSDVSTHS

SEQ ID NO: 1925 - protein, 255 aa, Homo sapiens
MGPPRHPQAGEIEAGGAGGGRRLQVEMSSQQFPRLGAPSTGLSQAPSQIANSGSAGLINPAATVNDESGRDSEVSAREHMSSSSSLQSREEKQEPVVVRPYPQVQMLSTHHAVASATPVAVTAPPAHLTPAVPLSFSEGLMKPPPKPTMPSRPIAPAPPSTLSLPPKVPGQVTVTMESSIPQASAIPVATISGQQGHPSNLHHIMTTNVQMSIIRSNAPGPPLHIGASHLPRGAAAAAVMSSSKVTTVLRPTSQL

SEQ ID NO: 1926 - protein, 255 aa, Homo sapiens
MSSMPKPERHAESLLDICHDTNSSPTDLMTVTKNQNIILQSISRSEEFDQDGDCSHSTLVNEEEDPSGGRQDWQPRTEGVEITVTFPRDVSPPQEMSQEDLKEKNLINSSLQEWAQAHAVSHPNEIETVELRKKKLTMRPLVLQKEESSRELCNVNLGFLLPRSCLELNISKSVTREDAPHFLKEQQRKSEEFSTSHMKYSGRSIKRHSSGLRIYDREEKFLISNEKKIFSENSLKSEEPILWTKGEILGKGAYG

SEQ ID NO: 1927 - protein, 255 aa, Homo sapiens
MSILIIEAFYGGSHKQLVDLLQEELGDCVVYTLPAKKWHWRARTSALYFSQTIPISEHYRTLFASSVLNLTELAALRPDLGKLKKILYFHENQLIYPVKKCQERDFQYGYNQILSCLVADVVVFNSVFNMESFLTSMGKFMKLIPDHRPKDLESIIRPKCQVIYFPIRFPDVSRFMPKHKTTHLKKMLGLKGNGGAVLSMALPFQPEQRDSEDLLKNFNSECDTHCGLDTARQEYLGNSLRQESDLKKSTSSDNS

SEQ ID NO: 1928 - protein, 255 aa, Homo sapiens
MSSRKSKSNSLIHTECLSQVQRILRERFCRQSPHSNLFGVQVQYKHLSELLKRTALHGESNSVLIIGPRGSGKTMLINHALKELMEIEEVSENVLQVHLNGLLQINDKIALKEITRQLNLENVVGDKVFGSFAENLSFLLEALKKGDRTSSCPVIFILDEFDLFAHHKNQTLLYNLFDISQSAQTPIAVIGLTCRLDILELLEKRVKSRFSHRQIHLMNSFGFPQYVKIFKEQLSLPAEFPDKVFAEKWNENVQY

SEQ ID NO: 1929 - protein, 255 aa, Homo sapiens
MPCVQAQYGSSPQGASPASQSYSYHSSGEYSSDFLTPEFVKFSMDLTNTEITATTSLPSFSTFMDNYSTGYDVKPPCLYQMPLSGQQSSIKVEDIQMHNYQQHSHLPPQSEEMMPHSGSVYYKPSSPPTPTTPGFQVQHSPMWDDPGSLHNFHQNYVATTHMIEQRKTPVSRLSLFSFKQSPPGTPVSSCQMRFDGPLHVPMNPEPAGSHHVVDGQTFAVPNPIRKPASMGFPGLQIGHASQLLDTQVPSPPSRG

SEQ ID NO: 1930 - protein, 255 aa, Homo sapiens
MKTPWKVLLGLLGAAALVTIITVPVVLLNKGTDDATADSRKTYTLTDYLKNTYRLKLYSLRWISDHEYLYKQENNILVFNAEYGNSSVFLENSTFDEFGHSINDYSISPDGQFILLEYNYVKQWRHSYTASYDIYDLNKRQLITEERIPNNTQWVTWSPVGHKLAYVWNNDIYVKIEPNLPSYRITWTGKEDIIYNGITDWVYEEEVFSAYSALWWSPNGTFLAYAQFNDTEVPLIEYSFYSDESLQYPKTVRVP

SEQ ID NO: 1931 - protein, 255 aa, Homo sapiens
MAHLKRLVKLHIKRHYHKKFWKLGAVIFFFIIVLVLMQREVSVQYSKEESRMERNMKNKNKMLDLMLEAVNNIKDAMPKMQIGAPVRQNIDAGERPCLQGYYTAAELKPVLDRPPQDSNAPGASGKAFKTTNLSVEEQKEKERGEAKHCFNAFASDRISLHRDLGPDTRPPECIEQKFKRCPPLPTTSVIIVFHNEAWSTLLRTVHSVLYSSPAILLKEIILVDDASVDEYLHDKLDEYVKQFSIVKIVRQRERK

SEQ ID NO: 1932 - protein, 255 aa, Homo sapiens
MLASPEPKGLVPFTKESFELIKQHIAKTHNEDHEEEDLKPTPDLEVGKKLPFIYGNLSQGMVSEPLEDVDPYYYKKKNTFIVLNKNRTIFRFNAASILCTLSPFNCIRRTTIKVLVHPFFQLFILISVLIDCVFMSLTNLPKWRPVLENTLLGIYTFEILVKLFARGVWAGSFSFLGDPWNWLDFSVTVFEVIIRYSPLDFIPTLQTARTLRILKIIPLNQGLKSLVGVLIHCLKQLIGVIILTLFFLSIFSLIG

SEQ ID NO: 1933 - protein, 255 aa, Homo sapiens
MVCGSPGGMLLLRAGLLALAALCLLRVPGARAAACEPVRIPLCKSLPWNMTKMPNHLHHSTQANAILAIEQFEGLLGTHCSPDLLFFLCAMYAPICTIDFQHEPIKPCKSVCERARQGCEPILIKYRHSWPENLACEELPVYDRGVCISPEAIVTADGADFPMDSSNGNCRGASSERCKCKPIRATQKTYFRNNYNYVIRAKVKEIKTKCHDVTAVVEVKEILKSSLVNIPRDTVNLYTSSGCLCPPLNVNEEYI

SEQ ID NO: 1934 - protein, 255 aa, Homo sapiens
MSRRRFDCRSISGLLTTTPQIPIKMENFNNFYILTSKELGRGKFAVVRQCISKSTGQEYAAKFLKKRRRGQDCRAEILHEIAVLELAKSCPRVINLHEVYENTSEIILILEYAAGGEIFSLCLPELAEMVSENDVIRLIKQILEGVYYLHQNNIVHLDLKPQNILLSSIYPLGDIKIVDFGMSRKIGHACELREIMGTPEYLAPEILNYDPITTATDMWNIGIIAYMLLTHTSPFVGEDNQETYLNISQVNVDYS

SEQ ID NO: 1935 - protein, 484 aa, Homo sapiens
MRHSKRTYCPDWDDKDWDYGKWRSSSSHKRRKRSHSSAQENKRCKYNHSKMCDSHYLESRSINEKDYHSRRYIDEYRNDYTQGCEPGHRQRDHESRYQNHSSKSSGRSGRSSYKSKHRIHHSTSHRRSHGKSHRRKRTRSVEDDEEGHLICQSGDVLSARYEIVDTLGEGAFGKVVECIDHKAGGRHVAVKIVKNVDRYCEAARSEIQVLEHLNTTDPNSTFRCVQMLEWFEHHGHICIVFELLGLSTYDFIKENGFLPFRLDHIRKMAYQICKSVNFLHSNKLTHTDLKPENILFVQSDYTEAYNPKIKRDERTLINPDIKVVDFGSATYDDEHHSTLVSTRHYRAPEVILALGWSQPCDVWSIGCILIEYYLGFTVFPTHDSKEHLAMMERILGPLPKHMIQKTRKRKYFHHDRLDWDEHSSAGRYVSRACKPLKEFMLSQDVEHERLFDLIQKMLEYDPAKRITLREALKHPFFDLLKKSI

SEQ ID NO: 1936 - protein, 255 aa, Homo sapiens
MIQSDKGADPPDKKDMKLSTATNPQNGLSQILRLVLQELSLFYSRDVNGVCLLYDLLHSPWLQALLKIYDCLQEFKEKKLVPATPHAQVLSYEVVELLRETPTSPEIQELRQMLQAPHFKALLSAHDTIAQKDFEPLLPPLPDNIPESEEAMRIVCLVKNQQPLGATIKRHEMTGDILVARIIHGGLAERSGLLYAGDKLVEVNGVSVEGLDPEQVIHILAMSRGTIMFKVVPVSDPPVNSQQMVYVRAMTEYWP

SEQ ID NO: 1937 - protein, 255 aa, Homo sapiens
MYEGKHIHFSEVDNKPLCSYSPKLCKQRRLNGYAFCIRHVLEDKTAPFKQCEYVAKYNSQRCTNPIPKSEDRRYCNSHLQVLGFIPKKERKKKNDPIDEVKVRHQMDTMAFSLTVPTLALKMPNGLDGMSLSPPGARVPLHYLETELEDPFAFNEEDDDLKKGATVRKKLQSKLAQNRQRQRETEILKVRQEHFSPPPAPSQQQPPQQHSHLSPLSTSLKPPAPPQGSVCKSPQPQNTSLPMQGVAPTTHTIAQA

SEQ ID NO: 1938 - protein, 255 aa, Homo sapiens
MDVLASYSIFQELQLVHDTGYFSALPSLEETWQQTCLELERYLQTEPRRISETFGEDLDCFLHASPPPCIEESFRRLDPLLLPVEAAICEKSSAVDILLSRDKLLSETCLSLQPASSSLDSYTAVNQAQLNAVTSLTPPSSPELSRHLVKTSQTLSAVDGTVTLKLVAKKAALSSVKVGGVATAAAAVTAAGAVKSGQSDSDQGGLGAEACPENKKRVHRCQFNGCRKVYTKSSHLKAHQRTHTGEKPYKCSWEG

SEQ ID NO: 1939 - protein, 218 aa, Homo sapiens
MALVPYEETTEFGLQKFHKPLATFSFANHTIQIRQDWRHLGVAAVVWDAAIVLSTYLEMGAVELRGRSAVELGAGTGLVGIVAALLGAHVTITDRKVALEFLKSNVQANLPPHIQTKTVVKELTWGQNLGSFSPGEFDLILGADIIYLEETFTDLLQTLEHLCSNHSVILLACRIRYERDNNFLAMLERQFTVRKVHYDPEKDVHIYEAQKRNQKEDL

SEQ ID NO: 1940 - protein, 255 aa, Homo sapiens
METRESEDLEKTRRKSASDQWNTDNEPAKVKPELLPEKEETSQADQDIQDKEPHCHIPIKRNSIFNRSIRRKSKAKARDNPERNASCLADSQDNGKSVNEPLTLNIPWSRMPPCRTAMQTDPGAQEMSESSSTPGNGATPEEWPALADSPTTLTEALRMIHPIPADSWRNLIEQIGLLYQEYRDKSTLQEIETRRQQDAEIEDNTNGSPASEDTPEEEEEEEEEEEPASPPERKTLPQICLLSNPHSRFNLWQDL

SEQ ID NO: 1941 - protein, 192 aa, Homo sapiens
MGNISSNISAFQSLHIVMLGLDSAGKTTVLYRLKFNEFVNTVPTIGFNTEKIKLSNGTAKGISCHFWDVGGQEKLRPLWKSYSRCTDGIIYVVDSVDVDRLEEAKTELHKVTKFAENQGTPLLVIANKQDLPKSLPVAEIEKQLALHELIPATTYHVQPACAIIGEGLTEGMDKLYEMILKRRKSLKQKKKR

SEQ ID NO: 1942 - protein, 212 aa, Homo sapiens
MAQAHRTPQPRAAPSQPRVFKLVLLGSGSVGKSSLALRYVKNDFKSILPTVGCAFFTKVVDVGATSLKLEIWDTAGQEKYHSVCHLYFRGANAALLVYDITRKDSFLKAQQWLKDLEEELHPGEVLVMLVGNKTDLSQEREVTFQEGKEFADSQKLLFMETSAKLNHQVSEVFNTVAQELLQRSDEEGQALRGDAAVALNKGPARQAKCCAH

SEQ ID NO: 1943 - protein, 255 aa, Homo sapiens
MHLAERDRWLFVATVMMHFVSIKSGFPGLCVGVRSTMSSVAVLTQESFAEHRSGLVPQQIKVATLNSEEESDPPTYKDAFPPLPEKAACLESAQEPAGAWGNKIRPIKASVITQVFHVPLEERKYKDMNQFGEGEQAKICLEIMQRTGAHLELSLAKDQGLSIMVSGKLDAVMKARKDIVARLQTQASATVAIPKEHHRFVIGKNGEKLQDLELKTATKIQIPRPDDPSNQIKITGTKEGIEKARHEVLLISAEQ

SEQ ID NO: 1944 - protein, 255 aa, Homo sapiens
MARMSFVIAACQLVLGLLMTSLTESSIQNSECPQLCVCEIRPWFTPQSTYREATTVDCNDLRLTRIPSNLSSDTQVLLLQSNNIAKTVDELQQLFNLTELDFSQNNFTNIKEVGLANLTQLTTLHLEENQITEMTDYCLQDLSNLQELYINHNQISTISAHAFAGLKNLLRLHLNSNKLKVIDSRWFDSTPNLEILMIGENPVIGILDMNFKPLANLRSLVLAGMYLTDIPGNALVGLDSLESLSFYDNKLVKVP

SEQ ID NO: 1945 - protein, 255 aa, Homo sapiens
MSIAIPLGVTTSDTSYSDMAAGSDPESVEASPAVNEKSVYSTHNYGTTQRHGCRGLPYATIIPRSDLNGLPSPVEERCGDSPNSEGETVPTWCPCGLSQDGFLLNCDKCRGMSRGKVIRLHRRKQDNISGGDSSATESWDEELSPSTVLYTATQHTPTSITLTVRRTKPKKRKKSPEKGRAAPKTKKIKNSPSEAQNLDENTTEGWENRIRLWTDQYEEAFTNQYSADVQNALEQHLHSSKEFVGKPTILDTINK

SEQ ID NO: 1946 - protein, 255 aa, Homo sapiens
MACYIYQLPSWVLDDLCRNMDALSEWDWMEFASYVITDLTQLRKIKSMERVQGVSITRELLWWWGMRQATVQQLVDLLCRLELYRAAQIILNWKPAPEIRCPIPAFPDSVKPEKPLAASVRKAEDEQEEGQPVRMATFPGPGSSPARAHQPAFLQPPEEDAPHSLRSDLPTSSDSKDFSTSIPKQEKLLSLAGDSLFWSEADVVQATDDFNQNRKISQGTFADVYRGHRHGKPFVFKKLRETACSSPGSIERFFQ

SEQ ID NO: 1947 - protein, 110 aa, Homo sapiens
MTEWPSPGKTSVVTGIKLWNIRVKARVCCELELRECLGIPPGISKGTMATASLAHVRHLLCQAFSVVEKGGRRMQLFQCCLAVPKSRDWAPHLTSNFRFTLGHSCLPLQS

SEQ ID NO: 1948 - protein, 255 aa, Homo sapiens
MAEAVFHAPKRKRRVYETYESPLPIPFGQDHGPLKEFKIFRAEMINNNVIVRNAEDIEQLYGKGYFGKGILSRSRPSFTISDPKLVAKWKDMKTNMPIITSKRYQHSVEWAAELMRRQGQDESTVRRILKDYTKPLEHPPVKRNEEAQVHDKLNSGMVSNMEGTAGGERPSVVNGDSGKSGGVGDPREPLGCLQEGSGCHPTTESFEKSVREDASPLPHVCCCKQDALILQRGLHHEDGSQHIGLLHPGDRGPDH

SEQ ID NO: 1949 - protein, 255 aa, Homo sapiens
MTSPSPRIQIISTDSAVASPQRIQGSEPASGPLSVFTSLNKEKIVTDQQTGQKIQIVTAVDASGSPKQQFILTSPDGAGTGKVILASPETSSAKQLIFTTSDNLVPGRIQIVTDSASVERLLGKTDVQRPQVVEYCVVCGDKASGRHYGAVSCEGCKGFFKRSVRKNLTYSCRSNQDCIINKHHRNRCQFCRLKKCLEMGMKMESVQSERKPFDVQREKPSNCAASTEKIYIRKDLRSPLIATPTFVADKDGARQ

SEQ ID NO: 1950 - protein, 193 aa, Homo sapiens
MSDDDSRASTSSSSSSSSNQQTEKETNTPKKKESKVSMSKNSKLLSTSAKRIQKELADITLDPPPNCSAGPKGDNIYEWRSTILGPPGSVYEGGVFFLDITFTPEYPFKPPKVTFRTRIYHCNINSQGVICLDILKDNWSPALTISKVLLSICSLLTDCNPADPLVGSIATQYMTNRAEHDRMARQWTKRYAT

SEQ ID NO: 1951 - protein, 119 aa, Homo sapiens
MKTMATRKRCKLSRTGPEFENVIKRLLCARTFHTRIGGDLTHGIINRGRRANAEQMGLQGSAQHFNIFPLDLWTQGDCMLVSLAKNKVNVFGAIINMAASVSGVIGGLKFSRTYYVKGI

SEQ ID NO: 1952 - protein, 255 aa, Homo sapiens
MAGFKRGYDGKIAGLYDLDKTLGRGHFAVVKLARHVFTGEKVAVKVIDKTKLDTLATGHLFQEVRCMKLVQHPNIVRLYEVIDTQTKLYLILELGDGGDMFDYIMKHEEGLNEDLAKKYFAQIVHAISYCHKLHVVHRDLKPENVVFFEKQGLVKLTDFGFSNKFQPGKKLTTSCGSLAYSAPEILLGDEYDAPAVDIWSLGVILFMLVCGQPPFQEANDSETLTMIMDCKYTVPSHVSKECKDLITRMLQRDPK

SEQ ID NO: 1953 - protein, 255 aa, Homo sapiens
MTRENVAHNALRQEGLVKGKDDTWKWGTSFQGSSSSVWETSHLHFRQLRYHETSGPQEALSRLRELCRRWLRPEARTKAQILELLVLEQFLSILPGEIRTWVQLHHPGSGEEAVALVEELQKDLDGPAIQVPVLVKDQDTLQKVVSAPGTTLPPVLPGSHIAAEICPHPPTDLVAFNLQDPQHDSPAPEASALSQEENPRNQLMALMLLTAQPQELVMFEEVSVCFTSEEWACLGPIQRALYWDVMLENYGNVTS

SEQ ID NO: 1954 - protein, 255 aa, Homo sapiens
MRGAGESGKSTIVKQMKIIHEDGYSEEECRQYRAVVYSNTIQSIMAIVKAMGNLQIDFADPSRADDARQLFALSCTAEEQGVLPDDLSGVIRRLWADHGVQACFGRSREYQLNDSAAYYLNDLERIAQSDYIPTQQDVLRTRVKTTGIVETHFTFKDLHFKMFDVGGQRSERKKWIHCFEGVTAIIFCVALSAYDLVLAEDEEMNRMHESMKLFDSICNNKWFTDTSIILFLNKKDLFEEKITHSPLTICFPEYT

SEQ ID NO: 1955 - protein, 255 aa, Homo sapiens
MESVVRRCPFLSRVPQAFLQKAGKSLLFYAQNCPKMMEVGAKPAPRALSTAAVHYQQIKETPPASEKDKTAKAKVQQTPDGSQQSPDGTQLPSGHPLPATSQGTASKCPFLAAQMNQRGSSVFCKASLELQEDVQEMNAVRKEVAETSAGPSVVSVKTDGGDPSGLLKNFQDIMQKQRPERVSHLLQDNLPKSVSTFQYDRFFEKKIDEKKNDHTYRVFKTVNRRAHIFPMADDYSDSLITKKQVSVWCSNDYLG

SEQ ID NO: 1956 - protein, 255 aa, Homo sapiens
MAPFLRIAFNSYELGSLQAEDEANQPFCAVKMKEALSTERGKTLVQKKPTMYPEWKSTFDAHIYEGRVIQIVLMRAAEEPVSEVTVGVSVLAERCKKNNGKAEFWLDLQPQAKVLMSVQYFLEDVDCKQSMRSEDEAKFPTMNRRGAIKQAKIHYIKNHEFIATFFGQPTFCSVCKDFVWGLNKQGYKCRQCNAAIHKKCIDKIIGRCTGTAANSRDTIFQKERFNIDMPHRFKVHNYMSPTFCDHCGSLLWGLV

SEQ ID NO: 1957 - protein, 255 aa, Homo sapiens
MMMMMMMKKMQHQRQQQADHANEANYARGTRLPLSGEGPTSQPNSSKQTVLSWQAAIDAARQAKAAQTMSTSAPPPVGSLSQRKRQQYAKSKKQGNSSNSRPARALFCLSLNNPIRRACISIVEWKPFDIFILLAIFANCVALAIYIPFPEDDSNSTNHNLEKVEYAFLIIFTVETFLKIIAYGLLLHPNAYVRNGWNLLDFVIVIVGLFSVILEQLTKETEGGNHSSGKSGGFDVKALRAFRVLRPLRLVSGVP

SEQ ID NO: 1958 - protein, 578 aa, Homo sapiens
MAFMEKPPAGKVLLDDTVPLTAAIEASQSLQSHTEYIIRVQRGISVENSWQIVRRYSDFDLLNNSLQIAGLSLPLPPKKLIGNMDREFIAERQKGLQNYLNVITTNHILSNCELVKKFLDPNNYSANYTEIALQQVSMFFRSEPKWEVVEPLKDIGWRIRKKYFLMKIKNQPKERLVLSWADLGPDKYLSDKDFQCLIKLLPSCLHPYIYRVTFATANESSALLIRMFNEKGTLKDLIYKAKPKDPFLKKYCNPKKIQGLELQQIKTYGRQILEVLKFLHDKGFPYGHLHASNVMLDGDTCRLLDLENSLLGLPSFYRSYFSQFRKINTLESVDVHCFGHLLYEMTYGRPPDSVPVDSFPPAPSMAVVAVLESTLSCEACKNGMPTISRLLQMPLFSDVLLTTSEKPQFKIPTKLKEALRIAKECIEKRLIEEQKQIHQHRRLTRAQSHHGSEEERKKRKILARKKSKRSALENSEEHSAKYSNSNNSAGSGASSPLTSPSSPTPPSTSGISALPPPPPPPPPPAAPLPPASTEAPAQLSSQAVNGMSRGALLSSIQNFQKGTLRKAKTCDHSAPKIG

SEQ ID NO: 1959 - protein, 255 aa, Homo sapiens
MRRLLEPCWWILFLKITSSVLHYVVCFPALTEGYVGALHENRHGSAVQIRRRKASGDPYWAYSGAYGPEHWVTSSVSCGGRHQSPIDILDQYARVGEEYQELQLDGFDNESSNKTWMKNTGKTVAILLKDDYFVSGAGLPGRFKAEKVEFHWGHSNGSAGSEHSINGRRFPVEMQIFFYNPDDFDSFQTAISENRIIGAMAIFFQVSPRDNSALDPIIHGLKGVVHHEKETFLDPFVLRDLLPASLGSYYRYTGS

SEQ ID NO: 1960 - protein, 892 aa, Homo sapiens
MSERAADDVRGEPRRAAAAAGGAAAAAARQQQQQQQQQQPPPPQPQRQQHPPPPPRRTRPEDGGPGAASTSAAAMATVGERRPLPSPEVMLGQSWNLWVEASKLPGKDGTELDESFKEFGKNREVMGLCREDMPIFGFCPAHDDFYLVVCNDCNQVVKPQAFQSHYERRHSSSSKPPLAVPPTSVFSFFPSLSKSKGGSASGSNRSSSGGVLSASSSSSKLLKSPKEKLQLRGNTRPMHPIQQSRVPHGRIMTPSVKVEKIHPKMDGTLLKSAVGPTCPATVSSLVKPGLNCPSIPKPTLPSPGQILNGKGLPAPPTLEKKPEDNSNNRKFLNKRLSEREFDPDIHCGVIDLDTKKPCTRSLTCKTHSLTQRRAVQGRRKRFDVLLAEHKNKTREKELIRHPDSQQPPQPLRDPHPAPPRTSQEPHQNPHGVIPSESKPFVASKPKPHTPSLPRPPGCPAQQGGSAPIDPPPVHESPHPPLPATEPASRLSSEEGEGDDKEESVEKLDCHYSGHHPQPASFCTFGSRQIGRGYYVFDSRWNRLRCALNLMVEKHLNAQLWKKIPPVPSTTSPISTRIPHRTNSVPTSQCGVSYLAAATVSTSPVLLSSTCISPNSKSVPAHGTTLNAQPAASGAMDPVCSMQSRQVSSSSSSPSTPSGLSSVPSSPMSRKPQKLKSSKSLRPKESSGNSTNCQNASSSTSGGSGKKRKNSSPLLVHSSSSSSSSSSSSHSMESFRKNCVAHSGPPYPSTVTSSHSIGLNCVTNKANAVNVRHDQSGRGPPTGSPAESIKRMSVMVNSSDSTLSLGPFIHQSNELPVNSHGSFSHSHTPLDKLIGKKRKCSPSSSSINNSSSKPTKVAKVPAVNNVHMKHTGTIPGAQGLMNSSLLHQPKARP

SEQ ID NO: 1961 - protein, 255 aa, Homo sapiens
MEKQCCSHPVICSLSTMYTFLLGAIFIALSSSRILLVKYSANEENKYDYLPTTVNVCSELVKLVFCVLVSFCVIKKDHQSRNLKYASWKEFSDFMKWSIPAFLYFLDNLIVFYVLSYLQPAMAVIFSNFSIITTALLFRIVLKRRLNWIQWASLLTLFLSIVALTAGTKTLQHNLAGRGFHHDAFFSPSNSCLLFRSECPRKDNCTAKEWTFPEAKWNTTARVFSHIRLGMGHVLIIVQCFISSMANIYNEKILK

SEQ ID NO: 1962 - protein, 255 aa, Homo sapiens
MNPFQKNESKETLFSPVSIEEVPPRPPSPPKKPSPTICGSNYPLSIAFIVVNEFCERFSYYGMKAVLILYFLYFLHWNEDTSTSIYHAFSSLCYFTPILGAAIADSWLGKFKVLSLIGLSLIALGTGGIKPCVAAFGGDQFEEKHAEERTRYFSVFYLSINAGSLISTFITPMLRGDVQCFGEDCYALAFGVPGLLMVIALVVFAMGSKIYNKPPPEGNIVAQVFKCIWFAISNRFKNRSGDIPKRQHWLDWAAE

SEQ ID NO: 1963 - protein, 255 aa, Homo sapiens
MEPVSTGAEAGMEGAGGDPYRRPARRTQWLLSALAHHYGLDRGVENEIVVLATGLDQYLQEVFHHLDCRGAGRLPRADFRALCAVLGLRAEGATTAGQAAGDGNSRDVTPGDAAAELATDGDSDTDEEARLALRAEPPELTFRQFHARLCGYFGTRAGPRLPRGALSEHIETQIRLRRPRRRRRPPCAPGPDSGPDCERVARLEEENSSLRELVEDLRAALQSSDARCLALQVGLWKSQASTHEMGHGGPEAAVR

SEQ ID NO: 1964 - protein, 255 aa, Homo sapiens
MNIIRENKDLACFYTTKHSWRGKYKRVFSVGTHAITTYNPNTLEVTNQWPYGDICSISPVGKGQGTEFNLTFRKGSGKKSETLKFSTEHRTELLTEALRFRTDFSEGKITGRRYNCYKHHWSDSRKPVILEVTPGGFDQINPATNRVLCSYDYRNIEGFVDLSDYQGGFCILYGGFSRLHLFASEQREEIIKSAIDHAGNYIGISLRIRKEPLEFEQYLNLRFGKYSTDESITSLAEFVVQKISPRHSEPVKRVL

SEQ ID NO: 1965 - protein, 255 aa, Homo sapiens
MAVTACQGLGFVVSLIGIAGIIAATCMDQWSTQDLYNNPVTAVFNYQGLWRSCVRESSGFTECRGYFTLLGLPAMLQAVRALMIVGIVLGAIGLLVSIFALKCIRIGSMEDSAKANMTLTSGIMFIVSGLCAIAGVSVFANMLVTNFWMSTANMYTGMGGMVQTVQTRYTFGAALFVGWVAGGLTLIGGVMMCIACRGLAPEETNYKAVSYHASGHSVAYKPGGFKASTGFGSNTKNKKIYDGGARTEDEVQSYP

SEQ ID NO: 1966 - protein, 255 aa, Homo sapiens
MTDQAFVTLTTNDAYAKGALVLGSSLKQHRTTRRLVVLATPQVSDSMRKVLETVFDEVIMVDVLDSGDSAHLTLMKRPELGVTLTKLHCWSLTQYSKCVFMDADTLVLANIDDLFDREELSAAPDPGWPDCFNSGVFVYQPSVETYNQLLHLASEQGSFDGGDQGILNTFFSSWATTDIRKHLPFIYNLSSISIYSYLPAFKVFGASAKVVHFLGRVKPWNYTYDPKTKSVKSEAHDPNMTHPEFLILWWNIFTT

SEQ ID NO: 1967 - protein, 194 aa, Homo sapiens
MRLLLLLLVAASAMVRSEASANLGGVPSKRLKMQYATGPLLKFQICVSGYRRVFEEYMRVISQRYPDIRIEGENYLPQPIYRHIASFLSVFKLVLIGLIIVGKDPFAFFGMQAPSIWQWGQENKVYACMMVFFLSNMIENQCMSTGAFEITLNDVPVWSKLESGHLPSMQQLVQILDNEMKLNVHMDSIPHHRS

SEQ ID NO: 1968 - protein, 255 aa, Homo sapiens
MAAFGLLSYEQRPLKRPRLGPPDVYPQDPKQKEDELTAVNVKQGFNNQPAFTGDEHGSARNIVINPSKIGAYFSSILAEKLKLNTFQDTGKKKPQVNAKDNYWLVTARSQSAIHSWFSDLAGNKPLSILAKKVPILSKKEDVFAYLAKYSVPMVRATWLIKMTCAYYSAISEAKIKKRQAPDPNLEWTQISTRYLREQLAKISDFYHMASSTGDGPVPVPPEVEQAMKQWEYNEKLAFHMFQEGMLEKHEYLTWI

SEQ ID NO: 1969 - protein, 183 aa, Homo sapiens
MREYKVVVLGSGGVGKSALTVQFVTGSFIEKYDPTIEDFYRKEIEVDSSPSVLEILDTAGTEQFASMRDLYIKNGQGFILVYSLVNQQSFQDIKPMRDQIIRVKRYERVPMILVGNKVDLEGEREVSYGEGKALAEEWSCPFMETSAKNKASVDELFAEIVRQMNYAAQPNGDEGCCSACVIL

SEQ ID NO: 1970 - protein, 255 aa, Homo sapiens
MQYSHHCEHLLERLNKQREAGFLCDCTIVIGEFQFKAHRNVLASFSEYFGAIYRSTSENNVFLDQSQVKADGFQKLLEFIYTGTLNLDSWNVKEIHQAADYLKVEEVVTKCKIKMEDFAFIANPSSTEISSITGNIELNQQTCLLTLRDYNNREKSEVSTDLIQANPKQGALAKKSSQTKKKKKAFNSPKTGQNKTVQYPSDILENASVELFLDANKLPTPVVEQVAQINDNSELELTSVVENTFPAQDIVHTVT

SEQ ID NO: 1971 - protein, 255 aa, Homo sapiens
MATCAEILRSEFPEIDGQVFDYVTGVLHSGSADFESVDDLVEAVGELLQEVSGDSKDDAGIRAVCQRMYNTLRLAEPQSQGNSQVLLDAPIQLSKITENYDCGTKLPGLLKREQSSTVNAKKLEKAEARLKAKQEKRSEKDTLKTSNPLVLEEASASQAGSRKESRLESSGKNKSYDVRIENFDVSFGDRVLLAGADVNLAWGRRYGLVGRNGLGKTTLLKMLATRSLRVPAHISLLHVEQEVAGDDTPALQSVL

SEQ ID NO: 1972 - protein, 255 aa, Homo sapiens
MENEPDHENVEQSLCAKTSEEELNKSFNLEASLSKFSYIDMDKELEFKNDLIDDKEFDIPQVDTPPTLESILNETDDEDESFILEDPTLLNIDTIDSHSYDTSSVASSDSGDRTNLKRKKKLPDSFSLHGSVMRHSLLKGISAQIVSAADKVDAGLPTAIAVSSLIAVGTSHGLALIFGKDQNQALRLCLGSTSVGGQYGAISALSINNDCSRLLCGFAKGQITMWDLASGKLLRSITDAHPPGTAILHIKFTDD

SEQ ID NO: 1973 - protein, 255 aa, Homo sapiens
MKALIAALLLITLQYSCAVSPTDCSAVEPEAEKALDLINKRRRDGYLFQLLRIADAHLDRVENTTVYYLVLDVQESDCSVLSRKYWNDCEPPDSRRPSEIVIGQCKVIATRHSHESQDLRVIDFNCTTSSVSSALANTKDSPVLIDFFEDTERYRKQANKALEKYKEENDDFASFRVDRIERVARVRGGEGTGYFVDFSVRNCPRHHFPRHPNVFGFCRADLFYDVEALDLESPKNLVINCEVFDPQEHENINGV

SEQ ID NO: 1974 - protein, 255 aa, Homo sapiens
MSGGSADYNREHGGPEGMDPDGVIESNWNEIVDNFDDMNLKESLLRGIYAYGFEKPSAIQQRAIIPCIKGYDVIAQAQSGTGKTATFAISILQQLEIEFKETQALVLAPTRELAQQIQKVILALGDYMGATCHACIGGTNVRNEMQKLQAEAPHIVVGTPGRVFDMLNRRYLSPKWIKMFVLDEADEMLSRGFKDQIYEIFQKLNTSIQVVLLSATMPTDVLEVTKKFMRDPIRILVKKEELTLEGIKQFYINVE

SEQ ID NO: 1975 - protein, 255 aa, Homo sapiens
MSHPSWLPPKSTGEPLGHVPARMETTHSFGNPSISVSTQQPPKKFAPVVAPKPKYNPYKQPGGEGDFLPPPPPPLDDSSALPSISGNFPPPPPLDEEAFKVQGNPGGKTLEERRSSLDAEIDSLTSILADLECSSPYKPRPPQSSTGSTASPPVSTPVTGHKRMVIPNQPPLTATKKSTLKPQPAPQAGPIPVAPIGTLKPQPQPVPASYTTASTSSRPTFNVQVKSAQPSPHYMAAPSSGQIYGSGPQGYNTQP

SEQ ID NO: 1976 - protein, 255 aa, Homo sapiens
MAEVSIDQSKLPGVKEVCRDFAVLEDHTLAHSLQEQEIEHHLASNVQRNRLVQHDLQVAKQLQEEDLKAQAQLQKRYKDLEQQDCEIAQEIQEKLAIEAERRRIQEKKDEDIARLLQEKELQEEKKRKKHFPEFPATRAYADSYYYEDGDQPGSRRARELGSGFSRPCRLQRDGKTVKHKKEKPEHPLENLEEPEQHCSSKRSLSSSSSGKGRDNPHINNEQHERKRSTQERPRRPLLPTISGEVFLSTECDDWE

SEQ ID NO: 1977 - protein, 156 aa, Homo sapiens
MSGGLLKALRSDSYVELSQYRDQHFRGDNEEQEKLLKKSCTLYVGNLSFYTTEEQIYELFSKSGDIKKIIMGLDKMKKTACGFCFVEYYSRADAENAMRYINGTRLDDRIIRTDWDAGFKEGRQYGRGRSGGQVRDEYRQDYDAGRGGYGKLAQNQ

SEQ ID NO: 1978 - protein, 255 aa, Homo sapiens
MSELKDCPLQFHDFKSVDHLKVCPRYTAVLARSEDDGIGIEELDTLQLELETLLSSASRRLRVLEAETQILTDWQDKKGDRRFLKLGRDHELGAPPKHGKPKKQKLEGKAGHGPGPGPGRPKSKNLQPKIQEYEFTDDPIDVPRIPKNDAPNRFWASVEPYCADITSEEVRTLEELLKPPEDEAEHYKIPPLGKHYSQRWAQEDLLEEQKDGARAAAVADKKKGLMGPLTELDTKDVDALLKKSEAQHEQPEDGC

SEQ ID NO: 1979 - protein, 322 aa, Homo sapiens
MVSVINTVDTSHEDMIHDAQMDYYGTRLATCSSDRSVKIFDVRNGGQILIADLRGHEGPVWQVAWAHPMYGNILASCSYDRKVIIWREENGTWEKSHEHAGHDSSVNSVCWAPHDYGLILACGSSDGAISLLTYTGEGQWEVKKINNAHTIGCNAVSWAPAVVPGSLIDHPSGQKPNYIKRFASGGCDNLIKLWKEEEDGQWKEEQKLEAHSDWVRDVAWAPSIGLPTSTIASCSQDGRVFIWTCDDASSNTWSPKLLHKFNDVVWHVSWSITANILAVSGGDNKVTLWKESVDGQWVCISDVNKGQGSVSASVTEGQQNEQ

SEQ ID NO: 1980 - protein, 224 aa, Homo sapiens
MPGSPRPAPSWVLLLRLLALLRPPGLGEACSCAPAHPQQHICHSALVIRAKISSEKVVPASADPADTEKMLRYEIKQIKMFKGFEKVKDVQYIYTPFDSSLCGVKLEANSQKQYLLTGQVLSDGKVFIHLCNYIEPWEDLSLVQRESLNHHYHLNCGCQITTCYTVPCTISAPNECLWTDWLLERKLYGYQAQHYVCMKHVDGTCSWYRGHLPLRKEFVDIVQP

SEQ ID NO: 1981 - protein, 255 aa, Homo sapiens
MASLQRKGLQARILTSEEEEKLKRDQTLVSDFKQQKLEQEAQKNWDLFYKRNSTNFFKDRHWTTREFEELRSCREFEDQKLTMLEAGCGVGNCLFPLLEEDPNIFAYACDFSPRAIEYVKQNPLYDTERCKVFQCDLTKDDLLDHVPPESVDVVMLIFVLSAVHPDKMHLVLQNIYKVLKPGKSVLFRDYGLYDHAMLRFKASSKLGENFYVRQDGTRSYFFTDDFLAQLFMDTGYEEVVNEYVFRETVNKKEGL

SEQ ID NO: 1982 - protein, 255 aa, Homo sapiens
MSTANPETPNSTISREASTQSSSAATSQGYILPEGKIMPNTVFVGGIDVRMDETEIRSFFARYGSVKEVKIITDRTGVSKGYGFVSFFNDVDVQKIVESQINFHGKKLKLGPAIRKQNLCAYHVQPRPLVFNHPPPPQFQNVWTNPNTETYMQPTTTMNPITQYVQAYPTYPNSPVQVITGYQLPVYNYQMPPQWPVGEQRSYVVPPAYSAVNYHCNEVDPGAEVVPNECSVHEATPPSGNGPQKKSVDRSIQTV

SEQ ID NO: 1983 - protein, 255 aa, Homo sapiens
MDHLNEATQGKEHSEMSNNVSDPKGPPAKIARLEQNGSPLGRGRLGSTGAKMQGVPLKHSGHLMKTNLRKGTMLPVFCVVEHYENAIEYDCKEEHAEFVLVRKDMLFNQLIEMALLSLGYSHSSAAQAKGLIQVGKWNPVPLSYVTDAPDATVADMLQDVYHVVTLKIQLHSCPKLEDLPPEQWSHTTVRNALKDLLKDMNQSSLAKECPLSQSMISSIVNSTYYANVSAAKCQEFGRWYKHFKKTKDMMVEMDS

SEQ ID NO: 1984 - protein, 255 aa, Homo sapiens
MANFLLPRGTSSFRRFTRESLAAIEKRMAEKQARGSTTLQESREGLPEEEAPRPQLDLQASKKLPDLYGNPPQELIGEPLEDLDPFYSTQKTFIVLNKGKTIFRFSATNALYVLSPFHPIRRAAVKILVHSLFNMLIMCTILTNCVFMAQHDPPPWTKYVEYTFTAIYTFESLVKILARGFCLHAFTFLRDPWNWLDFSVIIMAYVSENIKLGNLSALRTFRVLRALKTISVIPGLKTIVGALIQSVKKLADVMV

SEQ ID NO: 1985 - protein, 255 aa, Homo sapiens
MSVIFFACVVRVRDGLPLSASTDFYHTQDFLEWRRRLKSLALRLAQYPGRGSAEGCDFSIHFSSFGDVACMAICSCQCPAAMAFCFLETLWWEFTASYDTTCIGLASRPYAFLEFDSIIQKVKWHFNYVSSSQMECSLEKIQEELKLQPPAVLTLEDTDVANGVMNGHTPMHLEPAPNFRMEPVTALGILSLILNIMCAALNLIRGVHLAEHSLQVAHEEIGNILAFLVPFVACIFQCYLYLFYSPARTMKVVLM

SEQ ID NO: 1986 - protein, 255 aa, Homo sapiens
MMLIPTHHFRNIERKPEYLQPEKCVPPPYPGPVGTMWFIRDGCGIACAIVTWFLVLYAEFVVLFVMLIPSRDYVYSIINGIVFNLLAFLALASHCRAMLTDPGAVPKGNATKEFIESLQLKPGQVVYKCPKCCSIKPDRAHHCSVCKRCIRKMDHHCPWVNNCVGENNQKYFVLFTMYIALISLHALIMVGFHFLHCFEEDWTKCSSFSPPTTVILLILLCFEGLLFLIFTSVMFGTQVHSICTDETGIEQLKKE

SEQ ID NO: 1987 - protein, 255 aa, Homo sapiens; identical to SEQ ID NO: 1986

SEQ ID NO: 1988 - protein, 255 aa, Homo sapiens
MEKARPLWANSLQFVFACISYAVGLGNVWRFPYLCQMYGGGSFLVPYIIMLIVEGMPLLYLELAVGQRMRQGSIGAWRTISPYLSGVGVASVVVSFFLSMYYNVINAWAFWYLFHSFQDPLPWSVCPLNGNHTGYDEECEKASSTQYFWYRKTLNISPSLQENGGVQWEPALCLLLAWLVVYLCILRGTESTGKVVYFTASLPYCVLIIYLIRGLTLHGATNGLMYMFTPKIEQLANPKAWINAATQIFFSLGLG

SEQ ID NO: 1989 - protein, 255 aa, Homo sapiens
MAASVVCRAATAGAQVLLRARRSPALLRTPALRSTATFAQALQFVPETQVSLLDNGLRVASEQSSQPTCTVGVWIDVGSRFETEKNNGAGYFLEHLAFKGTKNRPGSALEKEVESMGAHLNAYSTREHTAYYIKALSKDLPKAVELLGDIVQNCSLEDSQIEKERDVILREMQENDASMRDVVFNYLHATAFQGTPLAQAVEGPSENVRKLSRADLTEYLSTHYKAPRMVLAAAGGVEHQQLLDLAQKHLGGIPW

SEQ ID NO: 1990 - protein, 382 aa, Homo sapiens
MSHIQIPPGLTELLQGYTVEVLRQQPPDLVEFAVEYFTRLREARAPASVLPAATPRQSLGHPPPEPGPDRVADAKGDSESEEDEDLEVPVPSRFNRRVSVCAETYNPDEEEEDTDPRVIHPKTDEQRCRLQEACKDILLFKNLDQEQLSQVLDAMFERIVKADEHVIDQGDDGDNFYVIERGTYDILVTKDNQTRSVGQYDNRGSFGELALMYNTPRAATIVATSEGSLWGLDRVTFRRIIVKNNAKKRKMFESFIESVPLLKSLEVSERMKIVDVIGEKIYKDGERIITQTKSNKDGGNQEVEIARCHKGQYFGELALVTNKPRAASAYAVGDVKCLVMDVQAFERLLGPCMDIMKRNISHYEEQLVKMFGSSVDLGNLGQ

SEQ ID NO: 1991 - protein, 255 aa, Homo sapiens
MADYLISGGTSYVPDDGLTAQQLFNCGDGLTYNDFLILPGYIDFTADQVDLTSALTKKITLKTPLVSSPMDTVTEAGMAIAMALTGGIGFIHHNCTPEFQANEVRKVKKYEQGFITDPVVLSPKDRVRDVFEAKARHGFCGIPITDTGRMGSRLVGIISSRDIDFLKEEEHDCFLEEIMTKREDLVVAPAGITLKEANEILQRSKKGKLPIVNEDDELVAIIARTDLKKNRDYPLASKDAKKQLLCGAAIGTHED

SEQ ID NO: 1992 - protein, 232 aa, Homo sapiens
PKCLTRKGPGAGPRRGSGHQSKTNRATGSPSVRRMKGGSALGTKTAQAKVARTLAKAARAQAKVARTQAKAAKARAKAKAALVKAKAKAKAAQVKAKAKVMAARAKAKAKAKAVRAKAKVARTQPRGRGRPKGSAKARTTRKGQKNRPETVGQKRKRAEEAKDLPPKKRTRLGPRSPKAWLGPGTAKLLKFRAIKVDRRSSDDEVRQRAQRILRVNLSPVIRLQPLLPYSAV

SEQ ID NO: 1993 - protein, 255 aa, Homo sapiens
MDALDASKLLDEELYSRQLYVLGSPAMQRIQGARVLVSGLQGLGAEVAKNLVLMGVGSLTLHDPHPTCWSDLAAQFLLSEQDLERSRAEASQELLAQLNRAVQVVVHTGDITEDLLLDFQVVVLTAAKLEEQLKVGTLCHKHGVCFLAADTRGLVGQLFCDFGEDFTVQDPTEAEPLTAAIQHISQGSPGILTLRKGANTHYFRDGDLVTFSGIEGMVELNDCDPRSIHVREDGSLEIGDTTTFSRYLRGGAITE

SEQ ID NO: 1994 - protein, 255 aa, Homo sapiens
MPFGCVTLGDKKNYNQPSEVTDRYDLGQVIKTEEFCEIFRAKDKTTGKLHTCKKFQKRDGRKVRKAAKNEIGILKMVKHPNILQLVDVFVTRKEYFIFLELATGREVFDWILDQGYYSERDTSNVVRQVLEAVAYLHSLKIVHRNLKLENLVYYNRLKNSKIVISDFHLAKLENGLIKEPCGTPEYLAPEVVGRQRYGRPVDCWAIGVIMYILLSGNPPFYEEVEEDDYENHDKNLFRKILAGDYEFDSPYWDDI

SEQ ID NO: 1995 - protein, 255 aa, Homo sapiens
MKLTDSVLRSFRVAKVFRENSDKINCFDFSPNGETVISSSDDDSIVLYDCQEGKPKRTLYSKKYGVDLIRYTHAANTVVYSSNKIDDTIRYLSLHDNKYIRYFPGHSKRVVALSMSPVDDTFISGSLDKTIRLWDLRSPNCQGLMHLQGKPVCSFDPEGLIFAAGVNSEMVKLYDLRSFDKGPFATFKMQYDRTCEWTGLKFSNDGKLILISTNGSFIRLIDAFKGVVMHTFGGYANSKAVTLEASFTPDSQFIM

SEQ ID NO: 1996 - protein, 255 aa, Homo sapiens
MSEHSRNSDQEELLDEEINEDEILANLSAEELKELQSEMEVMAPDPSLPVGMIQKDQTDKPPTGNFNHKSLVDYMYWEKASRRMLEEERVPVTFVKSEEKTQEEHEEIEKRNKNMAQYLKEKLNNEIVANKRESKGSSNIQETDEEDEEEEDDDDDDEGEDDGEESEETNREEEGKAKEQIRNCENNCQQVTDKAFKEQRDRPEAQEQSEKKISKLDPKKLALDTSFLKVSTRPSGNQTDLDGSLRRVRKNDPDM

SEQ ID NO: 1997 - protein, 255 aa, Homo sapiens
MMQESGTETKSNGSAIQNGSGGSNHLLECGGLREGRSNGETPAVDIGAADLAHAQQQQQQALQVARQLLLQQQQQQQVSGLKSPKRNDKQPALQVPVSVAMMTPQVITPQQMQQILQQQVLSPQQLQVLLQQQQALMLQQQQLQEFYKKQQEQLQLQLLQQQHAGKQPKEQQQVATQQLAFQQQLLQMQQLQQQHLLSLQRQGLLTIQPGQPALPLQPLAQGMIPTELQQLWKEVTSAHTAEETTGNNHSSLDLT

SEQ ID NO: 1998 - protein, 255 aa, Homo sapiens
MDDRYPALQRAQLRLDFIHANSTTHSFLFGALAELLDNARDAGAERLDVFSVDNEKLQGGFMLCFLDDGCGMSPEEASDIIYFGRSKKRLSTLKFIGQYGNGLKSGSMRIGKDFILFTKKEETMTCVFFSQTFCEEESLSEVVVPMPSWLIRTRESVTDDPQKFAMELSIIYKYSPFKTEAELMQQFDVIYGKCGTLLVIYNLKLLLNGEPELDVKTDKEDILMAGALEDFPARWSFRAYTSVLYFNPWMRIFIQ

SEQ ID NO: 1999 - protein, 255 aa, Homo sapiens; identical to SEQ ID NO: 1961

SEQ ID NO: 2000 - protein, 255 aa, Homo sapiens
MSGRPRTTSFAESCKPVQQPSAFGSMKVSRDKDGSKVTTVVATPGQGPDRPQEVSYTDTKVIGNGSFGVVYQAKLCDSGELVAIKKVLQDKRFKNRELQIMRKLDHCNIVRLRYFFYSSGEKKDEVYLNLVLDYVPETVYRVARHYSRAKQTLPVIYVKLYMYQLFRSLAYIHSFGICHRDIKPQNLLLDPDTAVLKLCDFGSAKQLVRGEPNVSYICSRYYRAPELIFGATDYTSSIDVWSAGCVLAELLLGQP

SEQ ID NO: 2001 - protein, 255 aa, Homo sapiens
MWKSVVGHDVSVSVETQGDDWDTDPDFVNDISEKEQRWGAKTIEGSGRTEHINIHQLRNKVSEEHDVLRKKEMESGPKASHGYGGRFGVERDRMDKSAVGHEYVAEVEKHSSQTDAAKGFGGKYGVERDRADKSAVGFDYKGEVEKHTSQKDYSRGFGGRYGVEKDKWDKAALGYDYKGETEKHESQRDYAKGFGGQYGIQKDRVDKSAVGFNEMEAPTTAYKKTTPIEAASSGTRGLKAKFESMAEEKRKREEE

SEQ ID NO: 2002 - protein, 538 aa, Homo sapiens
MTTPGKENFRLKSYKNKSLNPDEMRRRREEEGLQLRKQKREEQLFKRRNVATAEEETEEEVMSDGGFHEAQINNMEMAPGGVITSDMIEMIFSKSPEQQLSATQKFRKLLSKEPNPPIDEVISTPGVVARFVEFLKRKENCTLQFESAWVLTNIASGNSLQTRIVIQAGAVPIFIELLSSEFEDVQEQAVWALGNIAGDSTMCRDYVLDCNILPPLLQLFSKQNRLTMTRNAVWALSNLCRGKSPPPEFAKVSPCLNVLSWLLFVSDTDVLADACWALSYLSDGPNDKIQAVIDAGVCRRLVELLMHNDYKVVSPALRAVGNIVTGDDIQTQVILNCSALQSLLHLLSSPKESIKKEACWTISNITAGNRAQIQTVIDANIFPALISILQTAEFRTRKEAAWAITNATSGGSAEQIKYLVELGCIKPLCDLLTVMDSKIVQVALNGLENILRLGEQEAKRNGTGINPYCALIEEAYGLDKIEFLQSHENQEIYQKAFDLIEHYFGTEDEDSSIAPQVDLNQQQYIFQQCEAPMEGFQL

SEQ ID NO: 2003 - protein, 254 aa, Homo sapiens
MAAVAATAAAKGNGGGGGRAGAGDASGTRKKKGPGPLATAYLVIYNVVMTAGWLVIAVGLVRAYLAKGSYHSLYYSIEKPLKFFQTGALLEILHCAIGIVPSSVVLTSFQVMSRVFLIWAVTHSVKEVQSEDSVLLFVIAWTITEIIRYSFYTFSLLNHLPYLIKWARYTLFIVLYPMGVSGELLTIYAALPFVRQAGLYSISLPNKYNFSFDYYAFLILIMISYIPIFPQLYFHMIHQRRKILSHTEEHKKFE

SEQ ID NO: 2004 - protein, 255 aa, Homo sapiens
MGRRCCRRRVLAAACLGAALLLLCAAPRSLRPAFGNRALGSSWLGGEKRSPLQKLYDLDQDPRSTLAKVHRQRRDLLNSACSRHSRRQRLLQPEDLRHVLVDDAHGLLYCYVPKVACTNWKRVLLALSGQARGDPRAISAQEAHAPGRLPSLADFSPAEINRRLRAYLAFLFVREPFERLASAYRNKLARPYSAAFQRRYGARIVQRLRPRALPDARARGHDVRFAEFLAYLLDPRTRREEPFNEHWERAHALCH

SEQ ID NO: 2005 - protein, 255 aa, Homo sapiens
MEAPAAGLFLLLLLGTWAPAPGSASSEAPPLINEDVKRTVDLSSHLAKVTAEVVLAHLGGGSTSRATSFLLALEPELEARLAHLGVQVKGEDEEENNLEVRETKIKGKSGRFFTVKLPVALDPGAKISVIVETVYTHVLHPYPTQITQSEKQFVVFEGNHYFYSPYPTKTQTMRVKLASRNVESYTKLGNPTRSEDLLDYGPFRDVPAYSQDTFKVHYENNSPFLTITSMTRVIEVSHWGNIAVEENVDLKHTGA

SEQ ID NO: 2006 - protein, 409 aa, Homo sapiens
MSLHAWEWEEDPASIEPISSITSFYQSTSECDVEEHLKAKARAQESDSDRPCSSIESSSEPASTFSSDVPHVVPCKFTISLAFPVNMGQKGKYASLIEKYKKHPKTDSSVTKMRRFYHIEYFLLPDDEEPKKVDILLFPMVAKVFLESGVKTVKPWHEGDKAWVSWEQTFNITVTKELLKKINFHKITLRLWNTKDKMSRKVRYYRLKTAGFTDDVGAFHKSEVRHLVLNQRKLSEQGIENTNIVREESNQEHPPGKQEKTEKHPKSLQGSHQAEPETSSKNSEEYEKSLKMDDSSTIQWSVSRTPTISLAGASMMEIKELIESESLSSLTNILDRQRSQIKGKDSEGRRKIQRRHKKPLAEEEADPTLTGPRKQSAFSIQLAVMPLLAGTHCLPCSQQLLLVLWPERP

SEQ ID NO: 2007 - protein, 255 aa, Homo sapiens
MMASYPEPEDAAGALLAPETGRTVKEPEGPPPSPGKGGGGGGGTAPEKPDPAQKPPYSYVALIAMAIRESAEKRLTLSGIYQYIIAKFPFYEKNKKGWQNSIRHNLSLNECFIKVPREGGGERKGNYWTLDPACEDMFEKGNYRRRRRMKRPFRPPPAHFQPGKGLFGAGGAAGGCGVAGAGADGYGYLAPPKYLQSGFLNNSWPLPQPPSPMPYASCQMAAAAAAAAAAAAAAGPGSPGAAAVVKGLAGPAASY

SEQ ID NO: 2008 - protein, 255 aa, Homo sapiens
MILDEFYNVKFCIDASQPDVGSWLKYIRFAGCYDQHNLVACQINDQIFYRVVADIAPGEELLLFMKSEDYPHETMAPDIHEERQYRCEDCDQLFESKAELADHQKFPCSTPHSAFSMVEEDFQQKLESENDLQEIHTIQECKECDQVFPDLQSLEKHMLSHTEEREYKCDQCPKAFNWKSNLIRHQMSHDSGKHYECENCAKQVFTDPSNLQRHIRSQHVGARAHACPECGKTFATSSGLKQHKHIHSSVKPFIC

SEQ ID NO: 2009 - protein, 255 aa, Homo sapiens
MSLKNEPRVNTSALQKIAADMSNIIENLDTRELHFEGEEVDYDVSPSDPKIQEVYIPFSAIYNTQGFKEPNIQTYLSGCPIKAQVLEVERFTSTTRVPSINLYTIELTHGEFKWQVKRKFKHFQEFHRELLKYKAFIRIPIPTRRHTFRRQNVREEPREMPSLPRSSENMIREEQFLGRRKQLEDYLTKILKMPMYRNYHATTEFLDISQLSFIHDLGPKGIEGMIMKRSGGHRIPGLNCCGQGRACYRWSKRWL

SEQ ID NO: 2010 - protein, 255 aa, Homo sapiens
MSELEQLRQEAEQLRNQIQDARKACNDATLVQITSNMDSVGRIQMRTRRTLRGHLAKIYAMHWGYDSRLLVSASQDGKLIIWDSYTTNKMHAIPLRSSWVMTCAYAPSGNYVACGGLDNICSIYNLKTREGNVRVSRELPGHTGYLSCCRFLDDSQIVTSSGDTTCALWDIETAQQTTTFTGHSGDVMSLSLSPDMRTFVSGACDASSKLWDIRDGMCRQSFTGHVSDINAVSFFPNGYAFATGSDDATCRLFDL

SEQ ID NO: 2011 - protein, 255 aa, Homo sapiens
MVVERDDGSTLMEIDGDKGKQGGPTYYIDTNALRVPRENMEAISPLKNGMVEDWDSFQAILDHTYKMHVKSEASLHPVLMSEAPWNTRAKREKLTELMFEHYNIPAFFLCKTAVLTAFANGRSTGLILDSGATHTTAIPVHDGYVLQQGIVKSPLAGDFITMQCRELFQEMNIELVPPYMIASKEAVREGSPANWKRKEKLPQVTRSWHNYMCNCVIQDFQASVLQVSDSTYDEQVAAQMPTVHYEFPNGYNCDF

SEQ ID NO: 2012 - protein, 255 aa, Homo sapiens
MLMAGQRGAWTMGDVVEKSLEGPLAPSTDEPSQKTGDLVEILNGEKVKFDDAGLSLILQNGLETLRMENALTDVILCVDIQEFSCHRVVLAAASNYFRAMFCNDLKEKYEKRIIIKGVDAETMHTLLDYTYTSKALITKQNVQRVLEAANLFQFLRMVDACASFLTEALNPENCVGILRLADTHSLDSLKKQVQSYIIQNFVQILNSEEFLDLPVDTLHHILKSDDLYVTEEAQVFETVMSWVRHKPSERLCLLP

SEQ ID NO: 2013 - protein, 255 aa, Homo sapiens
MELTELLLVVMLLLTARLTLSSPAPPACDLRVLSKLLRDSHVLHSRLSQCPEVHPLPTPVLLPAVDFSLGEWKTQMEETKAQDILGAVTLLLEGVMAARGQLGPTCLSSLLGQLSGQVRLLLGALQSLLGTQLPPQGRTTAHKDPNAIFLSFQHLLRGKVRFLMLVGGSTLCVRRAPPTTAVPSRTSLVLTLNELPNRTSGLLETNFTASARTTGSGLLKWQQGFRAKIPGLLNQTSRSLDQIPGYLNRIHELLN

SEQ ID NO: 2014 - protein, 255 aa, Homo sapiens
MDGFYDQQVPFMVPGKSRSEECRGRPVIDRKRKFLDTDLAHDSEELFQDLSQLQEAWLAEAQVPDDEQFVPDFQSDNLVLHAPPPTKIKRELHSPSSELSSCSHEQALGANYGEKCLYNYCAYDRKPPSGFKPLTPPTTPLSPTHQNPLFPPPQATLPTSGHAPAAGPVQGVGPAPAPHSLPEPGPQQQTFAVPRPPHQPLQMPKMMPENQYPSEQRFQRQLSEPCHPFPPQPGVPGDNRPSYHRQMSEPIVPAA

SEQ ID NO: 2015 - protein, 255 aa, Homo sapiens
MASPADSCIQFTRHASDVLLNLNRLRSRDILTDVVIVVSREQFRAHKTVLMACSGLFYSIFTDQLKCNLSVINLDPEINPEGFCILLDFMYTSRLNLREGNIMAVMATAMYLQMEHVVDTCRKFIKASEAEMVSAIKPPREEFLNSRMLMPQDIMAYRGREVVENNLPLRSAPGCESRAFAPSLYSGLSTPPASYSMYSHLPVSSLLFSDEEFRDVRMPVANPFPKERALPCDSARPVPGEYSRPTLEVSPNVCH

SEQ ID NO: 2016 - protein, 255 aa, Homo sapiens
MEENSKKDHRALLNQGEEDELEVFGYRDHNVRKAFCLVASVLTCGGLLLVFYWRPQWRVWANCIPCPLQEADTVLLRTTDEFQRYMRKKVFCLYLSTLKFPVSKKWEESLVADRHSVINQALIKPELKLRCMEVQKIRYVWNDLEKRFQKVGLLEDSNSCSDIHQTFGLGLTSEEQEVRRLVCGPNAIEVEIQPIWKLLVKQVLNPFYVFQAFTLTLWLSQGYIEYSVAIIILTVISIVLSVYDLRQQSVKLHNL

SEQ ID NO: 2017 - protein, 255 aa, Homo sapiens
MGEAPSPAPALWDWDYLDRCFARHRVCISFGLWICASSCWIAAHALLLYLRCAQKPRQDQSALCAACCLLTSLCDTVGALLARQLTIQVFTGAYLAAIDLVNFMFILFPVCGSKFKSNSDREARERKRRRQLRASVFALALPLSLGPCWALWVAVPKASATIRGPQRRLLASLLQENTEILGYLLGSVAAFGSWASRIPPLSRIAPPPTLGITTQHEIWRGQMSKPSQSPSRSPSGHWRAAAQRQVLGTEMCRGK

SEQ ID NO: 2018 - protein, 794 aa, Homo sapiens [sequence omitted]

SEQ ID NO: 2019 - protein, 255 aa, Homo sapiens
MSLQVLNDKNVSNEKNTENCDFLFSPPEVTGRSSVLRVSQKENVPPKNLAKAMKVTFQTPLRDPQTHRILSPSMASKLEAPFTQDDTLGLENSHPVWTQKENQQLIKEVDAKTTHGILQKPVEADTDLLGDASPAFGSGSSSESGPGALADLDCSSSSQSPGSSENQMVSPGKVSGSPEQAVEENLSSYSLDRRVTPASETLEDPCRTESQHKAETPHGAEEECKAETPHGAEEECRHGGVCAPAAVATSPPGAI

SEQ ID NO: 2020 - protein, 217 aa, Homo sapiens
MEGSFSDGGALPEGLAEEAEPQGAAWSGDSGTVSQSHSSASGPWEDEGAEDGAPGRDLPLLRRAAAGYAACLLPGAGARPEVEALDASLEDLLTRVDEFVGMLDMLRGDSSHVVSEGVPRIHAKAAEMRRIYSRIDRLEAFVRMVGGRVARMEEQVTKAEAELGTFPRAFKKLLHTMNVPSLFSKSAPSRPQQAGYEAPVLFRTEDYFPCCSERPQL

SEQ ID NO: 2021 - protein, 255 aa, Homo sapiens
MAAQGCAASRLLQLLLQLLLLLLLLAAGGARARWRGEGTSAHLRDIFLGRCAEYRALLSPEQRNKNCTAIWEAFKVALDKDPCSVLPSDYDLFINLSRHSIPRDKSLFWENSHLLVNSFADNTRRFMPLSDVLYGRVADFLSWCRQKNDSGLDYQSCPTSEDCENNPVDSFWKRASIQYSKDSSGVIHVMLNGSEPTGAYPIKGFFADYEIPNLQKEKITRIEIWVMHEIGGPNVESCGEGSMKVLEKRLKDMGF

SEQ ID NO: 2022 - protein, 255 aa, Homo sapiens
MLMFDPVPVKQEAMDPVSVSYPSNYMESMKPNKYGVIYSTPLPEKFFQTPEGLSHGIQMEPVDLTVNKRSSPPSAGNSPSSLKFPSSHRRASPGLSMPSSSPPIKKYSPPSPGVQPFGVPLSMPPVMAAALSRHGIRSPGILPVIQPVVVQPVPFMYTSHLQQPLMVSLSEEMENSSSSMQVPVIESYEKPISQKKIKIEPGIEPQRTDYYPEEMSPPLMNSVSPPQALLQENHPSVIVQPGKRPLPVESPDTQR

SEQ ID NO: 2023 - protein, 247 aa, Homo sapiens
MADTTPNGPQGAGAVQFMMTNKLDTAMWLSRLFTVYCSALFVLPLLGLHEAASFYQRALLANALTSALRLHQRLPHFQLSRAFLAQALLEDSCHYLLYSLIFVNSYPVTMSIFPVLLFSLLHAATYTKKVLDARGSNSLPLLRSVLDKLSANQQNILKFIACNEIFLMPATVFMLFSGQGSLLQPFIYYRFLTLRYSSRRNPYCRTLFNELRIVVEHIIMKPACPLFVRRLCLQSIAFISRLAPTVP

SEQ ID NO: 2024 - protein, 255 aa, Homo sapiens
MRGARGAWDFLCVLLLLLRVQTGSSQPSVSPGEPSPPSIHPGKSDLIVRVGDEIRLLCTDPGFVKWTFEILDETNENKQNEWITEKAEATNTGKYTCTNKHGLSNSIYVFVRDPAKLFLVDRSLYGKEDNDTLVRCPLTDPEVTNYSLKGCQGKPLPKDLRFIPDPKAGIMIKSVKRAYHRLCLHCSVDQEGKSVLSEKFILKVRPAFKAVPVVSVSKASYLLREGEEFTVTCTIKDVSSSVYSTWKRENSQTKL

SEQ ID NO: 2025 - protein, 255 aa, Homo sapiens
MLVLRCRLGTSFPKLDNLVPKGKMKILLVFLGLLGNSVAMPMHMPRMPGFSSKSEEMMRYNQFNFMNGPHMAHLGPFFGNGLPQQFPQYQMPMWPQPPPNTWHPRKSSAPKRHNKTDQTQETQKPNQTQSKKPPQKRPLKQPSHNQPQPEEEAQPPQAFPPFGNGLFPYQQPPWQIPQRLPPPGYGRPPISNEEGGNPYFGYFGYHGFGGRPPYYSEEMFEQDFEKPKEEDPPKAESPGTEPTANSTVTETNSTQ

SEQ ID NO: 2026 - protein, 255 aa, Homo sapiens
MADRRRRLRPGTLAPVREGVNCRSRCFTKHKNGLKFPTSLHSRQLVFPRKGLDDFRKGCPPCTGLVTQVPVEGFLPQIYHRAPQLAPKKRQIKLLKEADVLSKLSPAQQARKAFLEDVEAHLTPHPLALYLNLEEAMPIELLSKVLEVLDPDRKLEDTWAYCQDTRKGMKEPTKLLKKHSTQVYLGPSKKTSVSNAGQWLYEEKPHKMDLLHENGPRPGLHENGISDIDEEFILKQFDIDYETKPSHDALHTMKL

SEQ ID NO: 2027 - protein, 255 aa, Homo sapiens
MVVLSVPAEVTVILLDIEGTTTPIAFVKDILFPYIEENVKEYLQTHWEEEECQQDVSLLRKQAEEDAHLDGAVPIPAASGNGVDDLQQMIQAVVDNVCWQMSLDRKTTALKQLQGHMWRAAFTAGRMKAEFFADVVPAVRKWREAGMKVYIYSSGSVEAQKLLFGHSTEGDILELVDGHFDTKIGHKVESESYRKIADSIGCSTNNILFLTDVTREASAAEEADVHVAVVVRPGNAGLTDDEKTYYSLITSFSEL

SEQ ID NO: 2028 - protein, 255 aa, Homo sapiens
MSNYSVSLVGPAPWGFRLQGGKDFNMPLTISSLKDGGKAAQANVRIGDVVLSIDGINAQGMTHLEAQNKIKGCTGSLNMTLQRASAAPKPEPVPVQKPTVTSVCSETSQELAEGQRRGSQGDSKQQNGKIPPKRPPRKHIVERYTEFYHVPTHSDASKKRLIEDTEDWRPRTGTTQSRSFRILAQITGTEHLKESEADNTKKAKFDSALEDLPKSGPHPPATPQVLTIGSQVATLSKVATTYSSLSSSTGNVEDS

SEQ ID NO: 2029 - protein, 93 aa, Homo sapiens [sequence omitted]

SEQ ID NO: 2030 - protein, 255 aa, Homo sapiens
MLLTLIILLPVVSKFSFVSLSAPQHWSCPEGTLAGNGNSTCVGPAPFLIFSHGNSIFRIDTEGTNYEQLVVDAGVSVIMDFHYNEKRIYWVDLERQLLQRVFLNGSRQERVCNIEKNVSGMAINWINEEVIWSNQQEGIITVTDMKGNNSHILLSALKYPANVAVDPVERFIFWSSEVAGSLYRADLDGVGVKALLETSEKITAVSLDVLDKRLFWIQYNREGSNSLICSCDYDGGSVHISKHPTQHNLFAMSLF

SEQ ID NO: 2031 - protein, 255 aa, Homo sapiens
MIVLLLFALLWMVEGVFSQLHYTVQEEQEHGTFVGNIAEDLGLDITKLSARGFQTVPNSRTPYLDLNLETGVLYVNEKIDREQICKQSPSCVLHLEVFLENPLELFQVEIEVLDINDNPPSFPEPDLTVEISESATPGTRFPLESAFDPDVGTNSLRDYEITPNSYFSLDVQTQGDGNRFAELVLEKPLDREQQAVHRYVLTAVDGGGGGGVGEGGGGGGGAGLPPQQQRTGTALLTIRVLDSNDNVPAFDQPVY

SEQ ID NO: 2032 - protein, 229 aa, Homo sapiens
MAEEMESSLEASFSSSGAVSGASGFLPPARSRIFKIIVIGDSNVGKTCLTYRFCAGRFPDRTEATIGVDFRERAVEIDGERIKIQLWDTAGQERFRKSMVQHYYRNVHAVVFVYDMTNMASFHSLPSWIEECKQHLLANDIPRILVGNKCDLRSAIQVPTDLAQKFADTHSMPLFETSAKNPNDNDHVEAIFMTLAHKLKSHKPLMLSQPPDNGIILKPEPKPAMTCWC

SEQ ID NO: 2033 - protein, 255 aa, Homo sapiens
MPCTCTWRNWRQWIRPLVAVIYLVSIVVAVPLCVWELQKLEVGIHTKAWFIAGIFLLLTIPISLWVILQHLVHYTQPELQKPIIRILWMVPIYSLDSWIALKYPGIAIYVDTCRECYEAYVIYNFMGFLTNYLTNRYPNLVLILEAKDQQKHFPPLCCCPPWAMGEVLLFRCKLGVLQYTVVRPFTTIVALICELLGIYDEGNFSFSNAWTYLVIINNMSQLFAMYCLLLFYKVLKEELSPIQPVGKFLCVKLVV

SEQ ID NO: 2034 - protein, 255 aa, Homo sapiens
MNEENIDGTNGCSKVRTGIQNEAALLALMEKTGYNMVQENGQRKFGGPPPGWEGPPPPRGCEVFVGKIPRDMYEDELVPVFERAGKIYEFRLMMEFSGENRGYAFVMYTTKEEAQLAIRILNNYEIRPGKFIGVCVSLDNCRLFIGAIPKEKKKEEILDEMKKVTEGVVDVIVYPSATDKTKNRGFAFVEYESHRAAAMARRKLIPGTFQLWGHTIQVDWADPEKEVDEETMQRVKVLYVRNLMISTTEETIKAE

SEQ ID NO: 2035 - protein, 255 aa, Homo sapiens
MQKIMHISVLLSPVLWGLIFGVSSNSIQIGGLFPRGADQEYSAFRVGMVQFSTSEFRLTPHIDNLEVANSFAVTNAFCSQFSRGVYAIFGFYDKKSVNTITSFCGTLHVSFITPSFPTDGTHPFVIQMRPDLKGALLSLIEYYQWDKFAYLYDSDRGLSTLQAVLDSAAEKKWQVTAINVGNINNDKKDEMYRSLFQDLELKKERRVILDCERDKVNDIVDQVITIGKHVKGYHYIIANLGFTDGDLLKIQFGGA

SEQ ID NO: 2036 - protein, 157 aa, Homo sapiens
MEGCAVRRGSCPLLPGPSAWRASPAGWAGRAKLRSWCRASGLPNRPYTLTGGRHGSVSLLRHPGTTTFVQQRSLHQSWEKRIVFSACPVSRSWCPERNFSGSIPAVTPPKLPGHSKSEGPPGKVRKRTTIRSQPLFVTRTRGFGSAVGWLPLGSPVL

SEQ ID NO: 2037 - protein, 255 aa, Homo sapiens
METPPLPPACTKQGHQKPLDSKDDNTEKHCPVTVNPWHMKKAFKVMNELRSQNLLCDVTIVAEDMEISAHRVVLAACSPYFHAMFTGEMSESRAKRVRIKEVDGWTLRMLIDYVYTAEIQVTEENVQVLLPAAGLLQLQDVKKTCCEFLESQLHPVNCLGIRAFADMHACTDLLNKANTYAEQHFADVVLSEEFLNLGIEQVCSLISSDKLTISSEEKVFEAVIAWVNHDKDVRQEFMARLMEHVRLPLLPREYL

SEQ ID NO: 2038 - protein, 255 aa, Homo sapiens
MGLGTLSPRMLVWLVASGIVFYGELWVCAGLDYDYTFDGNEEDKTETIDYKDPCKAAVFWGDIALDDEDLNIFQIDRTIDLTQNPFGNLGHTTGGLGDHAMSKKRGALYQLIDRIRRIGFGLEQNNTVKGKVPLQFSGQNEKNRVPRAATSRTERIWPGGVIPYVIGGNFTGSQRAMFKQAMRHWEKHTCVTFIERSDEESYIVFTYRPCGCCSYVGRRGNGPQAISIGKNCDKFGIVVHELGHVIGFWHEHTRP

SEQ ID NO: 2039 - protein, 255 aa, Homo sapiens
MIFLYQVVHFILFTSVSGECVTQLLKDTCFEGGDITTVFTPSAKYCQVVCTYHPRCLLFTFTAESPSEDPTRWFTCVLKDSVTETLPRVNRTAAISGYSFKQCSHQISACNKDIYVDLDMKGINYNSSVAKSAQECQERCTDDVHCHFFTYATRQFPSLEHRNICLLKHTQTGTPTRITKLDKVVSGFSLKSCALSNLACIRDIFPNTVFADSNIDSVMAPDAFVCGRICTHHPGCLFFTFFSQEWPKESQRNLC

SEQ ID NO: 2040 - protein, 255 aa, Homo sapiens
MACRPRSPPRHQSRCDGDASPPSPARWSLGRKRRADGRRWRPEDAEEAEHRGAERRPESFTTPEGPKPRSRCSDWASAVEEDEMRTRVNKEMARYKRKLLINDFGRERKSSSGSSDSKESMSTVPADFETDESVLMRRQKQINYGKNTIAYDRYIKEVPRHLRQPGIHPKTPNKFKKYSRRSWDQQIKLWKVALHFWDPPAEEGCDLQEIHPVDLESAESSSEPQTSSQDDFDVYSGTPTKVRHMDSQVEDEFDL

SEQ ID NO: 2041 - protein, 255 aa, Homo sapiens
MSCGNEFVETLKKIGYPKADNLNGEDFDWLFEGVEDESFLKWFCGNVNEQNVLSERELEAFSILQKSGKPILEGAALDEALKTCKTSDLKTPRLDDKELEKLEDEVQTLLKLKNLKIQRRNKCQLMASVTSHKSLRLNAKEEEATKKLKQSQGILNAMITKISNELQALTDEVTQLMMFFRHSNLGQGTNPLVFLSQFSLEKYLSQEEQSTAALTLYTKKQFFQGIHEVVESSNEDNFQLLDIQTPSICDNQEIL

SEQ ID NO: 2042 - protein, 255 aa, Homo sapiens
MAWDMCNQDSESVWSDIECAALVGEDQPLCPDLPELDLSELDVNDLDTDSFLGGLKWCSDQSEIISNQYNNEPSNIFEKIDEENEANLLAVLTETLDSLPVDEDGLPSFDALTDGDVTTDNEASPSSMPDGTPPPQEAEEPSLLKKLLLAPANTQLSYNECSGLSTQNHANHNHRIRTNPAIVKTENSWSNKAKSICQQQKPQRRPCSELLKYLTTNDDPPHTKPTENRNSSRDKCTSKKKSHTQSQSQHLQAKP

SEQ ID NO: 2043 - protein, 255 aa, Homo sapiens
MRLIRNIYIFCSIVMTAEGDAPELPEERELMTNCSNMSLRKVPADLTPATTTLDLSYNLLFQLQSSDFHSVSKLRVLILCHNRIQQLDLKTFEFNKELRYLDLSNNRLKSVTWYLLAGLRYLDLSFNDFDTMPICEEAGNMSHLEILGLSGAKIQKSDFQKIAHLHLNTVFLGFRTLPHYEEGSLPILNTTKLHIVLPMDTNFWVLLRDGIKTSKILEMTNIDGKSQFVSYEMQRNLSLENAKTSVLLLNKVDLL

SEQ ID NO: 2044 - protein, 99 aa, Homo sapiens
MAEGGFDPCECVCSHEHAMRRLINLLRQSQSYCTDTECLQELPGPSGDNGISVTMILVAWMVIALILFLLRPPNLRGSSLPGKPTSPHNGQDPPAPPVD

SEQ ID NO: 2045 - protein, 255 aa, Homo sapiens
MILSSYNTIQSVFCCCCCCSVQKRQMRTQISLSTDEELPEKYTQRRRPWLSQLSNKKQSNTGRVQPSKRKPLPPLPPSEVAEEKIQVKALYDFLPREPCNLALRRAEEYLILEKYNPHWWKARDRLGNEGLIPSNYVTENKITNLEIYEWYHRNITRNQAEHLLRQESKEGAFIVRDSRHLGSYTISVFMGARRSTEAAIKHYQIKKNDSGQWYVAERHAFQSIPELIWYHQHNAAGLMTRLRYPVGLMGSCLPA

SEQ ID NO: 2046 - protein, 255 aa, Homo sapiens
MQSKVLLAVALWLCVETRAASVGLPSVSLDLPRLSIQKDILTIKANTTLQITCRGQRDLDWLWPNNQSGSEQRVEVTECSDGLFCKTLTIPKVIGNDTGAYKCFYRETDLASVIYVYVQDYRSPFIASVSDQHGVVYITENKNKTVVIPCLGSISNLNVSLCARYPEKRFVPDGNRISWDSKKGFTIPSYMISYAGMVFCEAKINDESYQSIMYIVVVVGYRIYDVVLSPSHGIELSVGEKLVLNCTARTELNVG

SEQ ID NO: 2047 - protein, 117 aa, Homo sapiens
CIENVSRQNCPICLEDIHTSRVVAHVLPCGHLLHRGYRCPLCMHSALDMTRYWRQLDDEVAQTPMPSEYQNMTVDILCNDCNGRSTVQFHILGMKCKICESYNTAQAGGRRISLDQQ

SEQ ID NO: 2048 - protein, 255 aa, Homo sapiens
MRLIGMPKEKYDPPDPRRIYTIMSAEEVANGKKSHWAELEISGRVRSLSTSLWSLTHLTALHLNDNYLSRIPPDIAKLHNLVYLDLSSNKLRSLPAELGNMVSLRELLLNNNLLRVLPYELGRLFQLQTLGLKGNPLSQDILNLYQDPDGTRKLLNFMLDNLAVHPEQLPPRPWITLKERDQILPSASFTVMCYNVLCDKYATRQLYGYCPSWALNWEYRKKGIMEEIVNCDADIISLQEVETEQYFTLFLPALK

SEQ ID NO: 2049 - protein, 115 aa, Homo sapiens
MQAQAPVVVVTQPGVGPGPAPQNSNWQTGMCDCFSDCGVCLCGTFCFPCLGCQVAADMNECCLCGTSVAMRTLYRTRYGIPGSICDDYMATLCCPHCTLCQIKRDINRRRAMRTF

SEQ ID NO: 2050 - protein, 255 aa, Homo sapiens
MLLRSKPALPPPLMLLLLGPLGPLSPGALPRPAQAQDVVDLDFFTQEPLHLVSPSFLSVTIDANLATDPRFLILLGSPKLRTLARGLSPAYLRFGGTKTDFLIFDPKKESTFEERSYWQSQVNQDICKYGSIPPDVEEKLRLEWPYQEQLLLREHYQKKFKNSTYSRSSVDVLYTFANCSGLDLIFGLNALLRTADLQWNSSNAQLLLDYCSSKGYNISWELGNEPNSFLKKADIFINGSQLGEDFIQLHKLLRK

SEQ ID NO: 2051 - protein, 255 aa, Homo sapiens
MGTVPDPLRSAKTSLIAASGKEDDLGEPQAASPRHRPALLCKNANGFSGAPAEPDLSPRAAAEALMQVCEHETTQPDMSSPGVFNEVQKAPATFNSPGNPQLPGSSQPAASAPSSAAGRDLIHTPLTMPANQHTCQSIPGDQPNAITSSMPEDSLMRSQRTSNREQPEKPSCPVGGVLSSSKDQVSCEFPSPETIQGTVQTPVTAARVVSHSSSPVGGPEGERQGAICDSEMRSCKPLTRESGCSENKQPSVTAS

SEQ ID NO: 2052 - protein, 255 aa, Homo sapiens
MSALLRLLRTGAPAAACLRLGTSAGTGSRRAMALYHTEERGQPCSQNYRLFFKNVTGHYISPFHDIPLKVNSKEENGIPMKKARNDEYENLFNMIVEIPRWTNAKMEIATKEPMNPIKQYVKDGKLRYVANIFPYKGYIWNYGTLPQTWEDPHEKDKSTNCFGDNDPIDVCEIGSKILSCGEVIHVKILGILALIDEGETDWKLIAINANDPEASKFHDIDDVKKFKPGYLEATLNWFRLYKVPDGKPENQFAFN

SEQ ID NO: 2053 - protein, 255 aa, Homo sapiens
MLLKKHAGKGGGREPRSEDPTPAEQHCARTMPPCAVLAALLSVVAVVSCLYLGVKTNDLQARIAALESAKGAPSIHLLPDTLDHLKTMVQEKVERLLAQKSYEHMAKIRIAREAPSECNCPAGPPGKRGKRGRRGESGPPGQPGPQGPPGPKGDKGEQGDQGPRMVFPKINHGFLSADQQLIKRRLIKGDQGQAGPPGPPGPPGPRGPPGDTGKDGPRGMPGVPGEPGKPGEQGLMGPLGPPGQKGSIGAPGIPG

SEQ ID NO: 2054 - protein, 66 aa, Homo sapiens
MEVDAPGVDGRDGLRERRGFSEGGRQNFDVRPQSGANGLPKHSYWLDLWLFILFDVVVFLFVYFLP

SEQ ID NO: 2055 - protein, 255 aa, Homo sapiens
MQALNITPEQFSRLLRDHNLTREQFIALYRLRPLVYTPELPGRAKLALVLTGVLIFALALFGNALVFYVVTRSKAMRTVTNIFICSLALSDLLITFFCIPVTMLQNISDNWLGGAFICKMVPFVQSTAVVTEILTMTCIAVERHQGLVHPFKMKWQYTNRRAFTMLGVVWLVAVIVGSPMWHVQQLEIKYDFLYEKEHICCLEEWTSPVHQKIYTTFILVILFLLPLMVMLILYSKIGYELWIKKRVGDGSVLRT

SEQ ID NO: 2056 - protein, 255 aa, Homo sapiens
MAGLRNESEQEPLLGDTPGSREWDILETEEHYKSRWRSIRILYLTMFLSSVGFSVVMMSIWPYLQKIDPTADTSFLGWVIASYSLGQMVASPIFGLWSNYRPRKEPLIVSILISVAANCLYAYLHIPASHNKYYMLVARGLLGIGAGNVAVVRSYTAGATSLQERTSSMANISMCQALGFILGPVFQTCFTFLGEKGVTWDVIKLQINMYTTPVLLSAFLGILNIILILAILREHRVDDSGRQCKSINFEEASTD

SEQ ID NO: 2057 - protein, 255 aa, Homo sapiens
MSDEVFSTTLAYTKSPKVTKRTTFQDELIRAITARSARQRSSEYSDDFDSDEIVSLGDFSDTSADENSVNKKMNDFHISDDEEKNPSKLLFLKTNKSNGNITKDEPVCAIKNEEEMAPDGCEDIVVKSFSESQNKDEEFEKDKIKMKPKPRILSIKSTSSAENNSLDTDDHFKPSPRPRSMLKKKSHMEEKDGLEDKETALSEELELHSAPSSLPTPNGIQLEAEKKAFSENLDPEDSCLTSLASSSLKQILGDS

SEQ ID NO: 2058 - protein, 255 aa, Homo sapiens
MSLFGLLLLTSALAGQRQGTQAESNLSSKFQFSSNKEQNGVQDPQHERIITVSTNGSIHSPRFPHTYPRNTVLVWRLVAVEENVWIQLTFDERFGLEDPEDDICKYDFVEVEEPSDGTILGRWCGSGTVPGKQISKGNQIRIRFVSDEYFPSEPGFCIHYNIVMPQFTEAVSPSVLPPSALPLDLLNNAITAFSTLEDLIRYLEPERWQLDLEDLYRPTWQLLGKAFVFGRKSRVVDLNLLTEEVRLYSCTPRNF

SEQ ID NO: 2059 - protein, 255 aa, Homo sapiens
MMANDAKPDVKTVQVLRDTANRLRIHSIRATCASGSGQLTSCCSAAEVVSVLFFHTMKYKQTDPEHPDNDRFILSRGHAAPILYAAWVEVGDISESDLLNLRKLHSDLERHPTPRLPFVDVATGSLGQGLGTACGMAYTGKYLDKASYRVFCLMGDGESSEGSVWEAFAFASHYNLDNLVAVFDVNRLGQSGPAPLEHGADIYQNCCEAFGWNTYLVDGHDVEALCQAFWQASQVKNKPTAIVAKTFKGRGIPNI

SEQ ID NO: 2060 - protein, 255 aa, Homo sapiens
MQAHELFRYFRMPELVDFRQYVRTLPTNTLMGFGAFAALTTFWYATRPKPLKPPCDLSMQSVEVAGSGGARRSALLDSDEPLVYFYDDVTTLYEGFQRGIQVSNNGPCLGSRKPDQPYEWLSYKQVAELSECIGSALIQKGFKTAPDQFIGIFAQNRPEWVIIEQGCFAYSMVIVPLYDTLGNEAITYIVNKAELSLVFVDKPEKAKLLLEGVENKLIPGLKIIVVMDAYGSELVERGQRCGVEVTSMKAMEDLG

SEQ ID NO: 2061 - protein, 127 aa, Homo sapiens
MPKSKELVSSSSSGSDSDSEVDKKLKRKKQVAPEKPVKKQKTGETSRALSSSKQSSSSRDDNMFQIGKMRYVSVRDFKGKVLIDIREYWMDPEGEMKPGRKGISLNPEQWSQLKEQISDIDDAVRKL

SEQ ID NO: 2062 - protein, 255 aa, Homo sapiens
MATESTPSEIIERERKKLLEILQHDPDSILDTLTSRRLISEEEYETLENVTDLLKKSRKLLILVQKKGEATCQHFLKCLFSTFPQSAAICGLRHEVLKHENTVPPQSMGASSNSEDAFSPGIKQPEAPEITVFFSEKEHLDLETSEFFRDKKTSYRETALSARKNEKEYDTPEVTLSYSVEKVGCEVPATITYIKDGQRYEELDDSLYLGKEEYLGSVDTPEDAEATVEEEVYDDPEHVGYDGEEDFENSETTEF

SEQ ID NO: 2063 - protein, 255 aa, Homo sapiens
MWAVLRLALRPCARASPAGPRAYHGDSVASLGTQPDLGSALYQENYKQMKALVNQLHERVEHIKLGGGEKARALHISRGKLLPRERIDNLIDPGSPFLELSQFAGYQLYDNEEVPGGGIITGIGRVSGVECMIIANDATVKGGAYYPVTVKKQLRAQEIAMQNRLPCIYLVDSGGAYLPRQADVFPDRDHFGRTFYNQAIMSSKNIAQIAVVMGSCTAGGAYVPAMADENIIVRKQGTIFLAGPPLVKAATGEEV

SEQ ID NO: 2064 - protein, 255 aa, Homo sapiens
MVWDRQTKMEYEWKPDEQGLQQILQLLKESQSPDTTIQRTVQQKLEQLNQYPDFNNYLIFVLTKLKSEDEPTRSLSGLILKNNVKAHFQNFPNGVTDFIKSECLNNIGDSSPLIRATVGILITTIASKGELQNWPDLLPKLCSLLDSEDYNTCEGAFGALQKICEDSAEILDSDVLDRPLNIMIPKFLQFFKHSSPKIRSHAVACVNQFIISRTQALMLHIDSFIENLFALAGDEEPEVRKNVCRALVMLLEVRM

SEQ ID NO: 2065 - protein, 255 aa, Homo sapiens
MGCAPSIHVSQSGVIYCRDSDESSSPRQTTSVSQGPAAPLPGLFVQTDAADAIPPSRASGPPSVARVRRARTELGSGSSAGSAAPAATTSRGRRRHCCSSAEAETQTCYTSVKQVSSAEVRIGPMRLTQDPIQVLLIFAKEDSQSDGFWWACDRAGYRCNIARTPESALECFLDKHHEIIVIDHRQTQNFDAEAVCRSIRATNPSEHTVILAVVSRVSDDHEEASVLPLLHAGFNRRFMENSSIIACYNELIQIE

SEQ ID NO: 2066 - protein, 255 aa, Homo sapiens
MFPNSILGRPPFTPNHQQHNNFFTLSPTVYSHQQLIDAQFNFQNADLSRAVSLQQLTYGNVSPIQTSASPLFRGRKRLSDEKNLPLDGKRQRFHSPHQEPTVVNQIVPLSGERRYSMPPLFHTHYVPDIVRCVPPFREIAFLEPREITLPEAKDKLSQQILELFETCQQQISDLKKKELCRTQLQREIQLLFPQSRLFLVGSSLNGFGTRSSDGDLCLVVKEEPCFFQVNQKTEARHILTLVHKHFCTRLSGYIE

SEQ ID NO: 2067 - protein, 255 aa, Homo sapiens
MLAPRGAAVLLLHLVLQRWLAAGAQATPQVFDLLPSSSQRLNPGALLPVLTDPALNDLYVISTFKLQTKSSATIFGLYSSTDNSKYFEFTVMGRLNKAILRYLKNDGKVHLVVFNNLQLADGRRHRILLRLSNLQRGAGSLELYLDCIQVDSVHNLPRAFAGPSQKPETIELRTFQRKPQDFLEELKLVVRGSLFQVASLQDCFLQQSEPLAATGTGDFNRQFLGQMTQLNQLLGEVKDLLRQQVKETSFLRNTI

SEQ ID NO: 2068 - protein, 255 aa, Homo sapiens
MAASAGGPGSWSENILEYFLRNSQITAEDGAEITWYHAANHKAQTNEALKSTAHMIEADVLLPSDGSEHSQPIMAHPPETNSDNTLQEWLTEVMKSNKGIKLDFKSLAVVEPSMMLLENVKRHLKRPVWINADILPGPNGNSKVIDAKPFLDTVISFFPDVTFSLGWTTGWHPEKVNEGYSWTMVKEMEYICNELSQPVTFPVRAALVRQSCSQLLWLLKKSNRYSLTIWTGKNDNYSVEDLLYIRDHFDKKQVF

SEQ ID NO: 2069 - protein, 255 aa, Homo sapiens
MQKSVRYNEGHALYLAFLARKEGTKRGFLSKKTAEASRWHEKWFALYQNVLFYFEGEQSCRPAGMYLLEGCSCERTPAPPRAGAGQGGVRDALDKQYYFTVLFGHEGQKPLELRCEEEQDGKEWMEAIHQASYADILIEREVLMQKYIHLVQIVETEKIAANQLRHQLEDQDTEIERLKSEIIALNKTKERMRPYQSNQEDEDPDIKKIKKVQSFMRGWLCRRKWKTIVQDYICSPHAESMRKRNQIVFTMVEAE

SEQ ID NO: 2070 - protein, 255 aa, Homo sapiens
MAAEREPPPLGDGKPTDFEDLEDGEDLFTSTVSTLESSPSSPEPASLPAEDISANSNGPKPTEVVLDDDREDLFAEATEEVSLDSPEREPILSSEPSPAVTPVTPTTLIAPRIESKSMSAPVIFDRSREEIEEEANGDIFDIEIGVSDPEKVGDGMNAYMAYRVTTKTSLSMFSKSEFSVKRRFSDFLGLHSKLASKYLHVGYIVPPAPEKSIVGMTKVKVGKEDSSSTEFVEKRRAALERYLQRTVKHPTLLQD

SEQ ID NO: 2071 - protein, 255 aa, Homo sapiens
MATATPVPPRMGSRAGGPTTPLSPTRLSRLQEKEELRELNDRLAVYIDKVRSLETENSALQLQVTEREEVRGRELTGLKALYETELADARRALDDTARERAKLQIELGKCKAEHDQLLLNYAKKESDLNGAQIKLREYEAALNSKDAALATALGDKKSLEGDLEDLKDQIAQLEASLAAAKKQLADETLLKVDLENRCQSLTEDLEFRKSMYEEEINETRRKHETRLVEVDSGRQIEYEYKLAQALHEMREQHDA

SEQ ID NO: 2072 - protein, 255 aa, Homo sapiens
MVISLNSCLSFICLLLCHWIGTASPLNLEDPNVCSHWESYSVTVQESYPHPFDQIYYTSCTDILNWFKCTRHRVSYRTAYRHGEKTMYRRKSQCCPGFYESGEMCVPHCADKCVHGRCIAPNTCQCEPGWGGTNCSSACDGDHWGPHCTSRCQCKNGALCNPITGACHCAAGFRGWRCEDRCEQGTYGNDCHQRCQCQNGATCDHVTGECRCPPGYTGAFCEDLCPPGKHGPQCEQRCPCQNGGVCHHVTGECSC

SEQ ID NO: 2073 - protein, 77 aa, Homo sapiens
MWHLKLCAVLMIFLLLLGQIDGSPIPEVSSAKRRPRRMTPFWRGVSLRPIGASCRDDSECITRLCRKRRCSLSVAQE

SEQ ID NO: 2074 - protein, 255 aa, Homo sapiens
MYKETVYSAFNLLMHYPPPSGAGQHPQPQPPLHKANQPPHGVPQLSLYEHFNSPHPTPAPADISQKQVHRPLQTPDLSGFYSLTSGSMGQLPHTVSWFTHPSLMLGSGVPGHPAAIPHPAIVPPSGKQELQPFDRNLKTQAESKAEKEAKKPTIKKPLNAFMLYMKEMRAKVIAECTLKESAAINQILGRRWHALSREEQAKYYELARKERQLHMQLYPGWSARDNYGKKKRRSREKHQESTTGGKRNAFGTYPE

SEQ ID NO: 2075 - protein, 1761 aa, Homo sapiens
MADAAASPVGKRLLLLFADTAASASASAPAAAAASGDPGPALRTRAWRAGTVRAMSGAVPQDLAIFVEFDGCNWKQHSWVKVHAEEVIVLLLEGSLVWAPREDPVLLQGIRVSIAQWPALTFTPLVDKLGLGSVVPVEYLLDRELRFLSDANGLHLFQMGTDSQNQILLEHAALRETVNALISDQKLQEIFSRGPYSVQGHRVKIYQPEGEEGWLYGVVSHQDSITRLMEVSVTESGEIKSVDPRLIHVMLMDNSTPQSEGGTLKAVKSSKGKKKRESIEGKDGRRRKSASDSGCDPASKKLKGDRGEVDSNGSDGGEASRGPWKGGNASGEPGLDQRAKQPPSTFVPQINRNIRFATYTKENGRTLVVQDEPVGGDTPASFTPYSTATGQTPLAPEVGGAENKEAGKTLEQVGQGIVASAAVVTTASSTPNTVRISDTGLAAGTVPEKQKGSRSQASGENSRNSILASSGFGAPLPSSSQPLTFGSGRSQSNGVLATENKPLGFSFGCSSAQEAQKDTDLSKNLFFQCMSQTLPTSNYFTTVSESLADDSSSRDSFKQSLESLSSGLCKGRSVLGTDTKPGSKAGSSVDRKVPAESMPTLTPAFPRSLLNARTPENHENLFLQPPKLSREEPSNPFLAFVEKVEHSPFSSFASQASGSSSSATTVTSKVAPSWPESHSSADSASLAKKKPLFITTDSSKLVSGVLGSALTSGGPSLSAMGNGRSSSPTSSLTQPIEMPTLSSSPTEERPTVGPGQQDNPLLKTFSNVFGRHSGGFLSSPADFSQENKAPFEAVKRFSLDERSLACRQDSDSSTNSDLSDLSDSEEQLQAKTGLKGIPEHLMGKLGPNGERSAELLLGKSKGKQAPKGRPRTAPLKVGQSVLKDVSKVKKLKQSGEPFLQDGSCINVAPHLHKCRECRLERYRKFKEQEQDDSTVACRFFHFRRLIFTRKGVLRVEGFLSPQQSDPDAMNLWIPSSSLAEGIDLETSKYILANVGDQFCQLVMSEKEAMMMVEPHQKVAWKRAVRGVREMCDVCETTLFNIHWVCRKCGFGVCLDCYRLRKSRPRSETEEMGDEEVFSWLKCAKGQSHEPENLMPTQIIPGTALYNIGDMVHAARGKWGIKANCPCISRQNKSVLRPAVTNGMSQLPSINPSASSGNETTFSGGGGPAPVTTPEPDHVPKADSTDIRSEEPLKTDSSASNSNSELKAIRPPCPDTAPPSSALHWLADLATQKAKEETKEAGSLRSVLNKESHSPFGLDSFNSTAKVSPLTPKLFNSLLLGPTASNNKTEGSSLRDLLHSGPGKLPQTPLDTGIPFPPVFSTSSAGVKSKASLPNFLDHIIASVVENKKTSDASKRACNLTDTQKEVKEMVMGLNVLDPHTSHSWLCDGRLLCLHDPSNKNNWKIFRECWKQGQPVLVSGVHKKLKSELWKPEAFSQEFGDQDVDLVNCRNCAIISDVKVRDFWDGFEIICKRLRSEDGQPMVLKLKDWPPGEDFRDMMPTRFEDLMENLPLPEYTKRDGRLNLASRLPSYFVRPDLGPKMYNAYGLITAEDRRVGTTNLHLDVSDAVNVMVYVGIPIGEGAHDEEVLKTIDEGDADEVTKQRIHDGKEKPGALWHIYAAKDAEKIRELLRKVGEEQGQENPPDHDPIHDQSWYLDQTLRKRLYEEYGVQGWAIVQFLGDAVFIPAGAPHQVHNLYSCIKVAEDFVSPEHVKHCFRLTQEFRHLSNTHTNHEDKLQVKNIIYHAVKDAVGTLKAHESKLARS

SEQ ID NO: 2076 - protein, 255 aa, Homo sapiens
MSSLGGGSQDAGGSSSSSTNGSGGSGSSGPKAGAADKSAVVAAAAPASVADDTPPPERRNKSGIISEPLNKSLRRSRPLSHYSSFGSSGGSGGGSMMGGESADKATAAAAAASLLANGHDLAAAMAVDKSNPTSKHKSGAVASLLSKAERATELAAEGQLTLQQFAQSTEMLKRVVQEHLPLMSEAGAGLPDMEAVAGAEALNGQSDFPYLGAFPINPGLFIMTPAGVFLAESALHMAGLAEYPMQGELASAISS

SEQ ID NO: 2077 - protein, 255 aa, Homo sapiens
MEMKLPGQEGFEASSAPRNIPSGELDSNPDPGTGPSPDGPSDTESKELGVPKDPLLFIQLNELLGWPQALEWRETGSSSASLLLDMGEMPSITLSTHLHHRWVLFEEKLEVAAGRWSAPHVPTLALPSLQKLRSLLAEGLVLLDCPAQSLLELVEQVTRVESLSPELRGQLQALLLQRPQHYNQTTGTRPCWGSTHPRKASDNEEAPLREQCQNPLRQKLPPGAEAGTVLAGELGFLAQPLGAFVRLRNPVVLGS

SEQ ID NO: 2078 - protein, 255 aa, Homo sapiens
MLTDSGGGGTSFEEDLDSVAPRSAPAGASEPPPPGGVGLGIRTVRLFGEAGPASGVGSSGGGGSGSGTGGGDAALDFKLAAAVLRTGGGGGASGSDEDEVSEVESFILDQEDLDNPVLKTTSEIFLSSTAEGADLRTVDPETQARLEALLEAAGIGKLSTADGKAFADPEVLRRLTSSVSCALDEAAAALTRMKAENSHNAGQVDTRSLAEACSDGDVNAVRKLLDEGRSVNEHTEEGESLLCLACSAGYYELAQ

SEQ ID NO: 2079 - protein, 255 aa, Homo sapiens
MWRLPGLLGRALPRTLGPSLWRVTPKSTSPDGPQTTSSTLLVPVPNLDRSGPHGPGTSGGPRSHGWKDAFQWMSSRVSPNTLWDAISWGTLAVLALQLARQIHFQASLPAGPQRVEHCSWHSPLDRFFSSPLWHPCSSLRQHILPSPDGPAPRHTGLREPRLGQEEASAQPRNFSHNSLRGARPQDPSEEGPGDFGFLHASSSIESEAKPAQPQPTGEKEQDKSKTLSLEEAVTSIQQLFQLSVSIAFNFLGTEN

SEQ ID NO: 2080 - protein, 225 aa, Homo sapiens
MAVRSLWAGRLRVQRLLAWSAAWESKGWPLPFSTATQRTAGEDCRSEDPPDELGPPLAERALRVKAVKLEKEVQDLTVRYQRAIADCENIRRRTQRCVEDAKIFGIQSFCKDLVEVADILEKTTECISEESEPEDQKLTLEKVFRGLLLLEAKLKSVFAKHGLEKLTPIGDKYDPHEHELICHVPAGVGVQPGTVALVRQDGYKLHGRTIRLARVEVAVESQRRL

SEQ ID NO: 2081 - protein, 255 aa, Homo sapiens
MKLHCCLFTLVASIIVPAAFVLEDVDFDQMVSLEANRSSYNASFPSSFELSASSHSDDDVIIAKEGTSVSIECLLTASHYEDVHWHNSKGQQLDGRSRGGKWLVSDNFLNITNVAFDDRGLYTCFVTSPIRASYSVTLRVIFTSGDMSVYYMIVCLIAFTITLILNVTRLCMMSSHLRKTEKAINEFFRTEGAEKLQKAFEIAKRIPIITSAKTLELAKVTQFKTMEFARYIEELARSVPLPPLILNCRAFVEEM

SEQ ID NO: 2082 - protein, 255 aa, Homo sapiens
MASSLPWLCIILWLENALGKLEVEGNFYSENVSRILDNLLEGYDNRLRPGFGGAVTEVKTDIYVTSFGPVSDVEMEYTMDVFFRQTWTDERLKFGGPTEILSLNNLMVSKIWTPDTFFRNGKKSIAHNMTTPNKLFRIMQNGTILYTMRLTINADCPMRLVNFPMDGHACPLKFGSYAYPKSEIIYTWKKGPLYSVEVPEESSSLLQYDLIGQTVSSETIKSNTGEYVIMTVYFHLQRKMGYFMIQIYTPCIMTV

SEQ ID NO: 2083 - protein, 255 aa, Homo sapiens
MRKSPGLSDCLWAWILLLSTLTGRSYGQPSLQDELKDNTTVFTRILDRLLDGYDNRLRPGLGERVTEVKTDIFVTSFGPVSDHDMEYTIDVFFRQSWKDERLKFKGPMTVLRLNNLMASKIWTPDTFFHNGKKSVAHNMTMPNKLLRITEDGTLLYTMRLTVRAECPMHLEDFPMDAHACPLKFGSYAYTRAEVVYEWTREPARSVVVAEDGSRLNQYDLLGQTVDSGIVQSSTGEYVVMTTHFHLKRKIGYFVI

SEQ ID NO: 2084 - protein, 255 aa, Homo sapiens
MAPWRKADKERHGVAIYNFQGSGAPQLSLQIGDVVRIQETCGDWYRGYLIKHKMLQGIFPKSFIHIKEVTVEKRRNTENIIPAEIPLAQEVTTTLWEWGSIWKQLYVASKKERFLQVQSMMYDLMEWRSQLLSGTLPKDELKELKQKVTSKIDYGNKILELDLIVRDEDGNILDPDNTSVISLFHAHEEATDKITERIKEEMSKDQPDYAMYSRISSSPTHSLYVFVRNFVCRIGEDAELFMSLYDPNKQTVISE

SEQ ID NO: 2085 - protein, 255 aa, Homo sapiens
MALHFQSLAELEVLCTHLYIGTDLTQRIEAEKALLELIDSPECLSKCQLLLEQGTTSYAQLLAATCLSKLVSRVSPLPVEQRMDIRNYILNYVASQPKLAPFVIQALIQVIAKITKLGWFEVQKDQFVFREIIADVKKFLQGTVEHCIIGVIILSELTQEMNLVDYSRPSAKHRKIATSFRDTSLKDVLVLACSLLKEVFAKPLNLQDQCQQNLVMQVLKLVLNCLNFDFIGSSADESADDLCTVQIPTTWRTIF

SEQ ID NO: 2086 - protein, 255 aa, Homo sapiens
MPFDFRRFDIYRKVPKDLTQPTYTGAIISICCCLFILFLFLSELTGFITTEVVNELYVDDPDKDSGGKIDVSLNISLPNLHCELVGLDIQDEMGRHEVGHIDNSMKIPLNNGAGCRFEGQFSINKVPGNFHVSTHSATAQPQNPDMTHVIHKLSFGDTLQVQNIHGAFNALGGADRLTSNPLASHDYILKIVPTVYEDKSGKQRYSYQYTVANKEYVAYSHTGRIIPAIWFRYDLSPITVKYTERRQPLYRFITT

SEQ ID NO: 2087 - protein, 255 aa, Homo sapiens
MEYPAPATVQAADGGAAGPYSSSELLEGQEPDGVRFDRERARRLWEAVSGAQPVGREEVEHMIQKNQCLFTNTQCKVCCALLISESQKLAHYQSKKHANKVKRYLAIHGMETLKGETKKLDSDQKSSRSKDKNQCCPICNMTFSSPVVAQSHYLGKTHAKNLKLKQQSTKVEALHQNREMIDPDKFCSLCHATFNDPVMAQQHYVGKKHRKQETKLKLMARYGRLADPAVTDFPAGKGYPCKTCKIVLNSIEQYQ

SEQ ID NO: 2088 - protein, 255 aa, Homo sapiens
MPLKTRTALSDDPDSSTSTLGNMLELPGTSSSSTSQELPFCQPKKKSTPLKYEVGDLIWAKFKRRPWWPCRICSDPLINTHSKMKVSNRRPYRQYYVEAFGDPSERAWVAGKAIVMFEGRHQFEELPVLRRRGKQKEKGYRHKVPQKILSKWEASVGLAEQYDVPKGSKNRKCIPGSIKLDSEEDMPFEDCTNDPESEHDLLLNGCLKSLAFDSEHSADEKEKPCAKSRARKSSDNPKRTSVKKGHIQFEAHKDE

SEQ ID NO: 2089 - protein, 255 aa, Homo sapiens
MWSGRSSFTSLVVGVFVVYVVHTCWVMYGIVYTRPCSGDANCIQPYLARRPKLQLSVYTTTRSHLGAENNIDLVLNVEDFDVESKFERTVNVSVPKKTRNNGTLYAYIFLHHAGVLPWHDGKQVHLVSPLTTYMVPKPEEINLLTGESDTQQIEAEKKPTSALDEPVSHWRPRLALNVMADNFVFDGSSLPADVHRYMKMIQLGKTVHYLPILFIDQLSNRVKDLMVINRSTTELPLTVSYDKVSLGRLRFWIHM

SEQ ID NO: 2090 - protein, 252 aa, Homo sapiens
MLHQSGKFLIPDIKEEEKSYQVIRWFSPEDHQKRIKKHFDSYIETALDGRKESEALVKLMEIFGTQCSYLLSRKDIMDSLKNENYDLVFVEAFDFCSFLIAEKLVKPFVAILPTTFGSLDFGLPSPLSYVPVFPSLLTDHMDFWGRVKNFLMFFSFSRSQWDMQSTFDNTIKEHFPEGSRPVLSHLLLKAELWFVNSDFAFDFARPLLPNTVYIGGLMEKPIKPVPQNGQPALFTTPSLFSSGVYPEPLRWL

SEQ ID NO: 2091 - protein, 228 aa, Homo sapiens
MQSLPNSNGAAAGRDFKMKLWDVVAVCLVLLHTASAFPLPAGKRPPEAPAEDRSLGRRRAPFALSSDSNMPEDYPDQFDDVMDFIQATIKRLKRSPDKQMAVLPRRERNRQAAAANPENSRGKGRRGQRGKNRGCVLTAIHLNVTDLGLGYETKEELIFRYCSGSCDAAETTYDKILKNLSRNRRLVSDKVGQACCRPIAFDDDLSFLDDNLVYHILRKHSAKRCGCI

SEQ ID NO: 2092 - protein, 255 aa, Homo sapiens
MASFGWKRKIGEKVSKVTSQQFEAEAADEKDVVDNDEGNWLHAIKRRKEILLEGCAEKSKQLKDEGASLAENKRYREAIQKWDEALQLTPNDATLYEMKSQVLMSLHEMFPAVHAAEMAVQQNPHSWESWQTLGRAQLGLGEIILAIRSFQVALHIYPMNPEIWKEDLSWARTLQEQQKVAQRIKKSEAPAEVTHFSPKSIPDYDFESDEIVAVCAAIAEKEKTVSANKTMVIVSASGAIETVTEKEDGATPPDG

SEQ ID NO: 2093 - protein, 88 aa, Homo sapiens
MVPLCQVEVLYFAKSAEITGVRSETISVPQEIKALQLWKEIETRHPGLADVRNQIIFAVRQEYVELGDQLLVLQPGDEIAVIPPISGG

SEQ ID NO: 2094 - protein, 561 aa, Homo sapiens [sequence omitted]

SEQ ID NO: 2095 - protein, 255 aa, Homo sapiens
MSKVARSSSESDVQLWETEEDDMTEGDLGYGLGRKPGGIYEIEFSHRSRKRSDGKNFSPPPFPRKGEERNEASFQYSKHKSQQDTFPQVSRISNYRRQSSTVDSNSELSNEELRQCLNETLEEVEMLKTELEASQRQLRGKEEALKILQSMAILGKATSHTQAVLQKTMEQNRSLEKEINALQWEIEFDHNRFKNIEESWIQKYDRLNCENAVLKENLKVKTEEIKMLKSDNAVLNQRYLEALAMLDIKQQKMAQ

SEQ ID NO: 2096 - protein, 255 aa, Homo sapiens
MDTSTNLDIGAQLIVEECPSTYSLTGMPDIKIEHPLDPNSEEGSAQGVAMGMKFILPNRFDMNVCSRFVKSLNEEDSKNIQDQVNSDLEVASVLFKAECNIHTSPSPGIQVRHVYTPSTTKHFSPIKQSTTLTNKHRGNEVSTTPLLANSLSVHQLAAQGEMLYLATRIEQENVINHTDEEGFTPLMWAAAHGQIAVVEFLLQNGADPQLLGKGRESALSLACSKGYTDIVKMLLDCGVDVNEYDWNGGTPLLYA

SEQ ID NO: 2097 - protein, 255 aa, Homo sapiens
MKSLLLLVLISICWADHLSDNYTLDHDRAIHIQAENGPHLLVEAEQAKVFSHRGGNVTLPCKFYRDPTAFGSGIHKIRIKWTKLTSDYLKEVDVFVSMGYHKKTYGGYQGRVFLKGGSDSDASLVITDLTLEDYGRYKCEVIEGLEDDTVVVALDLQGVVFPYFPRLGRYNLNFHEAQQACLDQDAVIASFDQLYDAWRGGLDWCNAGWLSDGSVQYPITKPREPCGGQNTVPGVRNYGFWDKDKSRYDVFCFTS

SEQ ID NO: 2098 - protein, 255 aa, Homo sapiens
MTLCKYYEKRLLEFCSVFKPAMPRSVVGTACMYFKRFYLNNSVMEYHPRIIMLTCAFLACKVDEFNVSSPQFVGNLRESPLGQEKALEQILEYELLLIQQLNFHLIVHNPYRPFEGFLIDLKTRYPILENPEILRKTADDFLNRIALTDAYLLYTPSQIALTAILSSASRAGITMESYLSESLMLKENRTCLSQLLDIMKSMRNLVKKYEPPRSEEVAVLKQKLERCHSAELALNVITKKRKGYEDDDYVSKKSK

SEQ ID NO: 2099 - protein, 255 aa, Homo sapiens
MGVIGIQLVVTMVMASVMQKIIPHYSLARWLLCNGSLRWYQHPTEEELRILAGKQQKGKTKKDRKYNGHIESKPLTIPKDIDLHLETKSVTEVDTLALHYFPEYQWLVDFTVAATVVYLVTEVYYNFMKPTQEMNISLVWCLLVLSFAIKVLFSLTTHYFKVEDGGERSVCVTFGFFFFVKAMAVLIVTENYLEFGLETGFTNFSDSAMQFLEKQGLESQSPVSKLTFKFFLAIFCSFIGAFLTFPGLRLAQMHL

SEQ ID NO: 2100 - protein, 255 aa, Homo sapiens
MSALEWYAHKSLGDGIFWIQERFYESGNRANIWLVRGSEQDVVIDTGLGLRSLPEYLYSSGLLQDREAKEDAARRPLLAVATHVHFDHSGGLYQFDRVAVHHAEAEALARGDNFETVTWLSDSEVVRAPSPGWRARQFRVQAVQPTLILQDGDVINLGDRQLTVMHMPGHSRGSICLHDKDRKILFSGDVVYDGSLIDWLPYSRISDYVGTCERLIELVDRGLVEKVLPGHFNTFGAERLFRLASNYISKAGICH

SEQ ID NO: 2101 - protein, 255 aa, Homo sapiens
MEPRAAAAGEPEPPAASSSFQARLWKNLQLGVGRSKGGGGGRAGGPERRTADTPSPSPPPPVGTGNAPARGSGAGSRWSGFKKRKQVLDRVFSSSQPNLCCSSPEPLEPGGAGRAEQGSTLRRRIREHLLPAVKGPAAASGAAGGTPPGGRSPDSAPSSSSASSSLSSSPQPPPRGDRARDEGARRQGPGAHLCHQKSSSLPGTACLEQLLEPPPPPAEPARSPAESRAPETGEEHGSSQKIINTAGTSNAEVPL

SEQ ID NO: 2102 - protein, 224 aa, Homo sapiens
MPRPGSAQRWAAVAGRWGCRLLALLLLVPGPGGASEITFELPDNAKQCFYEDIAQGTKCTLEFQVITGGHYDVDCRLEDPDGKVLYKEMKKQYDSFTFTASKNGTYKFCFSNEFSTFTHKTVYFDFQVGEDPPLFPSENRVSALTQMESACVSIHEALKSVIDYQTHFRLREAQGRSRAEDLNTRVAYWSVGEALILLVVSIGQVFLLKSFFSDKRTTTTRVGS

SEQ ID NO: 2103 - protein, 255 aa, Homo sapiens
MPINKSEKPESCDNVKVVVRCRPLNEREKSMCYKQAVSVDEMRGTITVHKTDSSNEPPKTFTFDTVFGPESKQLDVYNLTARPIIDSVLEGYNGTIFAYGQTGTGKTFTMEGVRAIPELRGIIPNSFAHIFGHIAKAEGDTRFLVRVSYLEIYNEEVRDLLGKDQTQRLEVKERPDVGVYIKDLSAYVVNNADDMDRIMTLGHKNRSVGATNMNEHSSRSHAIFTITIECSEKGIDGNMHVRMGKLHLVDLAGSE

SEQ ID NO: 2104 - protein, 255 aa, Homo sapiens
MAAAVPKRMRGPAQAKLLPGSAIQALVGLARPLVLALLLVSAALSSVVSRTDSPSPTVLNSHISTPNVNALTHENQTKPSISQISTTLPPTTSTKKSGGASVVPHPSPTPLSQEEADNNEDPSIEEEDLLMLNSSPSTAKDTLDNGDYGEPDYDWTTGPRDDDESDDTLEENRGYMEIEQSVKSFKMPSSNIEEEDSHFFFHLIIFAFCIAVVYITYHNKRKIFLLVQSRKWRDGLCSKTVEYHRLDQNVNEAMP

SEQ ID NO: 2105 - protein, 160 aa, Homo sapiens
MPSIKLQSSDGEIFEVDVEIAKQSVTIKTMLEDLGMDDEGDDDPVPLPNVNAAILKKVIQWCTHHKDDPPPPEDDENKEKRTDDIPVWDQEFLKVDQGTLFELILAANYLDIKGLLDVTCKTVANMIKGKTPEEIRKTFNIKNDFTEEEEAQVGSTQFCL

SEQ ID NO: 2106 - protein, 111 aa, Homo sapiens
MSLLPRRAPPVSMRLLAAALLLLLLALYTARVDGSKCKCSRKGPKIRYSDVKKLEMKPKYPHCEEKMVIITTKSVSRYRGQEHCLHPKLQSTKRFIKWYNAWNEKRRVYEE

SEQ ID NO: 2107 - protein, 255 aa, Homo sapiens
MGKAFKVMNELRSKQLLCDVMIVAEDVEIEAHRVVLAACSPYFCAMFTGDMSESKAKKIEIKDVDGQTLSKLIDYIYTAEIEVTEENVQVLLPAASLLQLMDVRQNCCDFLQSQLHPTNCLGIRAFADVHTCTDLLQQANAYAEQHFPEVMLGEEFLSLSLDQVCSLISSDKLTVSSEEKVFEAVISWINYEKETRLEHMAKLMEHVRLPLLPRDYLVQTVEEEALIKNNNTCKDFLIEAMKYHLLPLDQRLLIK

SEQ ID NO: 2108 - protein, 255 aa, Homo sapiens
MERASCLLLLLLPLVHVSATTPEPCELDDEDFRCVCNFSEPQPDWSEAFQCVSAVEVEIHAGGLNLEPFLKRVDADADPRQYADTVKALRVRRLTVGAAQVPAQLLVGALRVLAYSRLKELTLEDLKITGTMPPLPLEATGLALSSLRLRNVSWATGRSWLAELQQWLKPGLKVLSIAQAHSPAFSCEQVRAFPALTSLDLSDNPGLGERGLMAALCPHKFPAIQNLALRNTGMETPTGVCAALAAAGVQPHSLD

SEQ ID NO: 2109 - protein, 255 aa, Homo sapiens
MSGFENLNTDFYQTSYSIDDQSQQSYDYGGSGGPYSKQYAGYDYSQQGRFVPPDMMQPQQPYTGQIYQPTQAYTPASPQPFYGNNFEDEPPLLEELGINFDHIWQKTLTVLHPLKVADGSIMNETDLAGPMVFCLAFGATLLLAGKIQFGYVYGISAIGCLGMFCLLNLMSMTGVSFGCVASVLGYCLLPMILLSSFAVIFSLQGMVGIILTAGIIGWCSFSASKIFISALAMEGQQLLVAYPCALLYGVFALIS

SEQ ID NO: 2110 - protein, 255 aa, Homo sapiens
MAERKGTAKVDFLKKIEKEIQQKWDTERVFEVNASNLEKQTSKGKYFVTFPYPYMNGRLHLGHTFSLSKCEFAVGYQRLKGKCCLFPFGLHCTGMPIKACADKLKREIELYGCPPDFPDEEEEEEETSVKTEDIIIKDKAKGKKSKAAAKAGSSKYQWGIMKSLGLSDEEIVKFSEAEHWLDYFPPLAIQDLKRMGLKVDWRRSFITTDVNPYYDSFVRWQFLTLRERNKIKFGKRYTIYSPKDGQPCMDHDRQT

SEQ ID NO: 2111 - protein, 255 aa, Homo sapiens
MPSAEAKLKKNRCANCFDCPGCMHTLSTRATSISTQLPDDPAKTTMKKAYYLACGFCRWTSRDVGMADKSVASGGWQEPENPHTQRMNKLIEYYQQLAQKEKVERDRKKLARRRNYMPLAFSDKYGLGTRLQRPRAGASISTLAGLSLKEGEDQKEIKIEPAQAVDEVEPLPEDYYTRPVNLTEVTTLQQRLLQPDFQPVCASQLYPRHKHLLIKRSLRCRKCEHNLSKPEFNPTSIKFKIQLVAVNYIPEVRIM

SEQ ID NO: 2112 - protein, 255 aa, Homo sapiens
MGCRHSRLSSCKPPKKKRQEPEPEQPPRPEPHELGPLNGDTAITVQLCASEEAERHQKDITRILQQHEEEKKKWAQQVEKERELELRDRLDEQQRVLEGKNEEALQVLRASYEQEKEALTHSFREASSTQQETIDRLTSQLEAFQAKMKRVEESILSRNYKKHIQDYGSPSQFWEQELESLHFVIEMKNERIHELDRRLILMETVKEKNLILEEKITTLQQENEDLHVRSRNQVVLSRQLSEDLLLTREALEKEV

SEQ ID NO: 2113 - protein, 68 aa, Homo sapiens [sequence omitted]

SEQ ID NO: 2114 - protein, 255 aa, Homo sapiens
MSKEPLILWLMIEFWWLYLTPVTSETVVTEVLGHRVTLPCLYSSWSHNSNSMCWGKDQCPYSGCKEALIRTDGMRVTSRKSAKYRLQGTIPRGDVSLTILNPSESDSGVYCCRIEVPGWFNDVKINVRLNLQRASTTTHRTATTTTRRTTTTSPTTTRQMTTTPAALPTTVVTTPDLTTGTPLQMTTIAVFTTANTCLSLTPSTLPEEATGLLTPEPSKEGPILTAESETVLPSDSWSSVESTSADTVLLTSKES

SEQ ID NO: 2115 - protein, 255 aa, Homo sapiens
MPGGAGAARLCLLAFALQPLRPRAAREPGWTRGSEEGSPKLQHELIIPQWKTSESPVREKHPLKAELRVMAEGRELILDLEKNEQLFAPSYTETHYTSSGNPQTTTRKLEDHCFYHGTVRETELSSVTLSTCRGIRGLITVSSNLSYVIEPLPDSKGQHLIYRSEHLKPPPGNCGFEHSKPTTRDWALQFTQQTKKRPRRMKREDLNSMKYVELYLVADYLEFQKNRRDQDATKHKLIEIANYVDKFYRSLNIRI

SEQ ID NO: 2116 - protein, 255 aa, Homo sapiens
MAPGWAGVGAAVRARLALALALASVLSGPPAVACPTKCTCSAASVDCHGLGLRAVPRGIPRNAERLDLDRNNITRITKMDFAGLKNLRVLHLEDNQVSVIERGAFQDLKQLERLRLNKNKLQVLPELLFQSTPKLTRLDLSENQIQGIPRKAFRGITDVKNLQLDNNHISCIEDGAFRALRDLEILTLNNNNISRILVTSFNHMPKIRTLRLHSNHLYCDCHLAWLSDWLRQRRTVGQFTLCMAPVHLRGFNVAD

SEQ ID NO: 2117 - protein, 255 aa, Homo sapiens
MRPWALAVTRWPPSAPVGQRRFSAGPGSTPGQLWGSPGLEGPLASPPARDERLPSQQPPSRPPHLPVEERRASAPAGGSPRMLHPATQQSPFMVDLHEQVHQGPVPLSYTVTTVTTQGFPLPTGQHIPGCSAQQLPACSVMFSGQHYPLCCLPPPLIQACTMQQLPVPYQAYPHLISSDHYILHPPPPAPPPQPTHMAPLGQFVSLQTQHPRMPLQRLDNDVDLRGDQPSLGSFTYSTSAPGPALSPSVPLHYLP

SEQ ID NO: 2118 - protein, 255 aa, Homo sapiens
MTRGARLRSDARAQLNQLSLDGGTGSGQKGKCEEFPSSLSSVSPGLEAAALLLAVTMDPLETPIKDGILYQQHVKFGKKCWRKVWALLYAGGPSGVARLESWEVRDGGLGAAGDRSAGPGRRGERRVIRLADCVSVLPADGESCPRDTGAFLLTTTERSHLLAAQHRQAWMGPICQLAFPGTGEASSGSTDAQSPKRGLVPMEENSIYSSWQEVGEFPVVVQRTEAATRCQLKGPALLVLGPDAIQLREAKGTQA

SEQ ID NO: 2119 - protein, 255 aa, Homo sapiens
MRLRNGTFLTLLLFCLCAFLSLSWYAALSGQKGDVVDVYQREFLALRDRLHAAEQESLKRSKELNLVLDEIKRAVSERQALRDGDGNRTWGRLTEDPRLKPWNGSHRHVLHLPTVFHHLPHLLAKESSLQPAVRVGQGRTGVSVVMGIPSVRREVHSYLTDTLHSLISELSPQEKEDSVIVVLIAETDSQYTSAVTENIKALFPTEIHSGLLEVISPSPHFYPDFSRLRESFGDPKERVRWRTKQNLDYCFLMMY

SEQ ID NO: 2120 - protein, 255 aa, Homo sapiens
MASLTVKAYLLGKEDAAREIRRFSFCCSPEPEAEAEAAAGPGPCERLLSRVAALFPALRPGGFQAHYRDEDGDLVAFSSDEELTMAMSYVKDDIFRIYIKEKKECRRDHRPPCAQEAPRNMVHPNVICDGCNGPVVGTRYKCSVCPDYDLCSVCEGKGLHRGHTKLAFPSPFGHLSEGFSHSRWLRKVKHGHFGWPGWEMGPPGNWSPRPPRAGEARPGPTAESASGPSEDPSVNFLKNVGESVAAALSPLGIEV

SEQ ID NO: 2121 - protein, 255 aa, Homo sapiens
MPQTLSASDMVTPGSLSPPPTEPTDGEQAGQPLLDGAPSSASLETLIQHLVPTADYYPEKAYIFTFLLSSRLFIEPRELLARVCHLCIEQQQLDKPVLDKARVRKFGPKLLQLLAEWTETFPRDFQEESTIGHLKDVVGRIAPCDEAYRKRMHQLLQALHQKLAALRQGPEGLVGADKPISYRTKPPASIHRELLGVCSDPYTLAQQLTHVELERLRHIGPEEFVQAFVNKDPLASTKPCFSDKTSNLEAYVKWF

SEQ ID NO: 2122 - protein, 255 aa, Homo sapiens
MLKKQSAGLVLWGAILFVAWNALLLLFFWTRPAPGRPPSVSALDGDPASLTREVIRLAQDAEVELERQRGLLQQIGDALSSQRGRVPTAAPPAQPRVPVTPAPAVIPILVIACDRSTVRRCLDKLLHYRPSAELFPIIVSQDCGHEETAQAIASYGSAVTHIRQPDLSSIAVPPDHRKFQGYYKIARHYRWALGQVFRQFRFPAAVVVEDDLEVAPDFFEYFRATYPLLKADPSLWCVSAWNDNGKEQMVDASRP

SEQ ID NO: 2123 - protein, 451 aa, Homo sapiens
MNLEGGGRGGEFGMSAVSCGNGKLRQWLIDQIDSGKYPGLVWENEEKSIFRIPWKHAGKQDYNREEDAALFKAWALFKGKFREGIDKPDPPTWKTRLRCALNKSNDFEELVERSQLDISDPYKVYRIVPEGAKKGAKQLTLEDPQMSMSHPYTMTTPYPSLPAQQVHNYMMPPLDRSWRDYVPDQPHPEIPYQCPMTFGPRGHHWQGPACENGCQVTGTFYACAPPESQAPGVPTEPSIRSAEALAFSDCRLHICLYYREILVKELTTSSPEGCRISHGHTYDASNLDQVLFPYPEDNGQRKNIEKLLSHLERGVVLWMAPDGLYAKRLCQSRIYWDGPLALCNDRPNKLERDQTCKLFDTQQFLSELQAFAHHGRSLPRFQVTLCFGEEFPDPQRQRKLITAHVEPLLARQLYYFAQQNSGHFLRGYDLPEHISNPEDYHRSIRHSSIQE

SEQ ID NO: 2124 - protein, 255 aa, Homo sapiens
MPRTKQIHPRNLRDKIEEAQKELNGAEVSKKEILQAGVKGTSESLKGVKRKKIVAENHLKKIPKSPLRNPLQAKHKQNTEESSFAVLHSASESHKKQNYIPVKNGKQFTKQNGETPGIIAEASKSEESVSPKKPLFLQQPSELRRWRSEGADPAKFSDLDEQCDSSSLSSKTRTDNSECISSHCGTTSPSYTNTAFDVLLKAMEPELSTLSQKGSPCAIKTEKLRPNKTARSPPKLKNSSMDAPNQTSQELVAES

SEQ ID NO: 2125 - protein, 255 aa, Homo sapiens
MRKGIQPALEQYLVTAGGGEGAAVVAAAAAASMDKRALLASPGFAAAAAAAAAPGAYIQILTTNTSTTSCSSSLQSGAVAAGPLLPSAPGAEQTAGSLLYTTPHGPSSRAGLLQQPPALGRGGSGGGGGPPAKRRLELGESGHQYLSDGLKTPKGKGRAALRSPDSPKTPKSPSEKTRYDTSLGLLTKKFIQLLSQSPDGVLDLNKAAEVLKVQKRRIYDITNVLEGIHLIKKKSKNNVQWMGCSLSEDGGMLAQ

SEQ ID NO: 2126 - protein, 103 aa, Homo sapiens [sequence omitted]

SEQ ID NO: 2127 - protein, 126 aa, Homo sapiens
MPEPVKSAPVPKKGSKKAINKAQKKDGKKRKRSRKESYSVYVYKVLKQVHPDTGISSKAMGIMNSFVNDIFERIAGEASRLAHYNKRSTITSREIQTAVRLLLPGELAKHAVSEGTKAVTKYTSSK

SEQ ID NO: 2128 - protein, 247 aa, Homo sapiens
MASLSRPSLPSCLCSFLLLLLLQVSSSYAGQFRVIGPRHPIRALVGDEVELPCRISPGKNATGMEVGWYRPPFSRVVHLYRNGKDQDGDQAPEYRGRTELLKDAIGEGKVTLRIRNVRFSDEGGFTCFFRDHSYQEEAAMELKVEDPFYWVSPGVLVLLAVLPVLLLQITVGLIFLCLQYRLRGKLRAEIENLHRTFDPHFLRVPCWKITLFVIVPVLGPLVALIICYNWLHRRLAGQFLEELRNPF

SEQ ID NO: 2129 - protein, 126 aa, Homo sapiens
MSVMDLANTCSSFQSDLDFCSDCGSVLPLPGAQDTVTCIRCGFNINVRDFEGKVVKTSVVFHQLGTAMPMSVEEGPECQGPVVDRRCPRCGHEGMAYHTRQMRSADEGQTVFYTCTNCKFQEKEDS

SEQ ID NO: 2130 - protein, 255 aa, Homo sapiens
MPATPSLKVVHELPACTLCAGPLEDAVTIPCGHTFCRLCLPALSQMGAQSSGKILLCPLCQEEEQAETPMAPVPLGPLGETYCEEHGEKIYFFCENDAEFLCVFCREGPTHQAHTVGFLDEAIQPYRDRLRSRLEALSTERDEIEDVKCQEDQKLQVLLTQIESKKHQVETAFERLQQELEQQRCLLLARLRELEQQIWKERDEYITKVSEEVTRLGAQVKELEEKCQQPASELLQDVRVNQSRCEMKTFVSPEA

SEQ ID NO: 2131 - protein, 162 aa, Homo sapiens
QWRLKSARRRSPLCWLVVPDKEDPEGNHTLPCRAPGFSSAKLTLTRLQEGKEPTPDSRLKGTRTREMRHTRAGQLWGSFQRGAEIRLPGGAPGPGGAPQCDWVKCFQRTRVEVGGISSRPCRHLPQNPRAPPSSLLNGNAGDVLSHPLSTHTSPLIWKFFSL

SEQ ID NO: 2132 - protein, 255 aa, Homo sapiens
MSDRSGPTAKGKDGKKYSSLNLFDTYKGKSLEIQKPAVAPRHGLQSLGKVAIARRMPPPANLPSLKAENKGNDPNVSLVPKDGTGWASKQEQSDPKSSDASTAQPPESQPLPASQTPASNQPKRPPAAPENTPLVPSGVKSWAQASVTHGAHGDGGRASSLLSRFSREEFPTLQAAGDQDKAAKERESAEQSSGPGPSLRPQNSTTWRDGGGRGPDELEGPDSKLHHGHDPRGGLQPSGPPQFPPYRGMMPPFMY

SEQ ID NO: 2133 - protein, 143 aa, Homo sapiens [sequence omitted]

SEQ ID NO: 2134 - protein, 255 aa, Homo sapiens
MSEMSSFLHIGDIVSLYAEGSVNGFISTLGLVDDRCVVEPAAGDLDNPPKKFRDCLFKVCPMNRYSAQKQYWKAKQTKQDKEKIADVVLLQKLQHAAQMEQKQNDTENKKVHGDVVKYGSVIQLLHMKSNKYLTVNKRLPALLEKNAMRVTLDATGNEGSWLFIQPFWKLRSNGDNVVVGDKVILNPVNAGQPLHASNYELSDNAGCKEVNSVNCNTSWKINLFMQFRDHLEEVLKGGDVVRLFHAEQEKFLTCD

SEQ ID NO: 2135 - protein, 255 aa, Homo sapiens
MSQERPTFYRQELNKTIWEVPERYQNLSPVGSGAYGSVCAAFDTKTGLRVAVKKLSRPFQSIIHAKRTYRELRLLKHMKHENVIGLLDVFTPARSLEEFNDVYLVTHLMGADLNNIVKCQKLTDDHVQFLIYQILRGLKYIHSADIIHRDLKPSNLAVNEDCELKILDFGLARHTDDEMTGYVATRWYRAPEIMLNWMHYNQTVDIWSVGCIMAELLTGRTLFPGTDHINQLQQIMRLTGTPPAYLINRMPSHEA

SEQ ID NO: 2136 - protein, 255 aa, Homo sapiens
MSLIRKKGFYKQDVNKTAWELPKTYVSPTHVGSGAYGSVCSAIDKRSGEKVAIKKLSRPFQSEIFAKRAYRELLLLKHMQHENVIGLLDVFTPASSLRNFYDFYLVMPFMQTDLQKIMGMEFSEEKIQYLVYQMLKGLKYIHSAGVVHRDLKPGNLAVNEDCELKILDFGLARHADAEMTGYVVTRWYRAPEVILSWMHYNQTVDIWSVGCIMAEMLTGKTLFKGKDYLDQLTQILKVTGVPGTEFVQKLNDKAA

SEQ ID NO: 2137 - protein, 255 aa, Homo sapiens
MVQMMRQFLYRVLPEDSYKVTTGKLHVSLTRLTDGENVVVSEFTSKEELIEALYCSCFVPVYCGLIPPTYRGVRYIDGGFTGMQPCAFWTDAITISTFSGQQDICPRDCPAIFHDFRMFNCSFQFSLENIARMTHALFPPDLVILHDYYYRGYEDAVLYLRRLNAVYLNSSSKRVIFPRVEVYCQIELALGNECPERSQPSLRARQASLEGATQPHKEWVPKGDGRGSHGPPVSQPVQTLEFTCESPVSAPVSPL

SEQ ID NO: 2138 - protein, 164 aa, Homo sapiens
MHRDSCPLDCKVYVGNLGNNGNKTELERAFGYYGPLRSVWVARNPPGFAFVEFEDPRDAADAVRELDGRTLCGCRVRVELSNGEKRSRNRGPPPSWGRRPRDDYRRRSPPPRRRSPRRRSFSRSRSRSLSRDRRRERSLSRERNHKPSRSFSRSRSRSRSNERK

SEQ ID NO: 2139 - protein, 164 aa, Homo sapiens
MSEPAGDVRQNPCGSKACRRLFGPVDSEQLSRDCDALMAGCIQEARERWNFDFVTETPLEGDFAWERVRGLGLPKLYLPTGPRRGRDELGGGRRPGTSPALLQGTAEEDHVDLSLSCTLVPRSGEQAEGSPGGPGDSQGRKRRQTSMTDFYHSKRRLIFSKRKP

SEQ ID NO: 2140 - protein, 255 aa, Homo sapiens
MMVESASETIRSAPSGQNGVGSLSGQADGSSGGATGTTASGTGREVTTGADSNGEMSPAELLHFQQQQALQVARQFLLQQASGLSSPGNNDSKQSASAVQVPVSVAMMSPQMLTPQQMQQILSPPQLQALLQQQQALMLQQLQEYYKKQQEQLHLQLLTQQQAGKPQPKEALGNKQLAFQQQLLQMQQLQQQHLLNLQRQGLVSLQPNQASGPLQTLPQAAVCPTDLPQLWKGEGAPGQPAEDSVKQEGLDLTGT

SEQ ID NO: 2141 - protein, 255 aa, Homo sapiens
MVGERHAGDLMVPLGPRLQAYPEELIRQRPGHDGHPEYLIRWSVLKCGEVGKVGVEEGKAEHILMWLSAPEVYANCPGLLGERALSKGLQHEPAGVSGSFPRDPGGLDEVAMGEMEADVQALVRRAARQLAESGTPSLTAAVLHTIHVLSAYASIGPLTGVFRETGALDLLMHMLCNPEPQIRRSAGKMLQALAAHDAGSRAHVLLSLSQQDGIEQHMDFDSRYTLLELFAETTSSEEHCMAFEGIHLPQIPGKL

SEQ ID NO: 2142 - protein, 172 aa, Homo sapiens
MRIPVDPSTSRRFSPPSSSLQPGKMSDVSPVVAAQQQQQQQQQQQQQQQQQQQQQQQEAAAAAAAAAAAVPRLRPPHDNRTMVEIIADHPAELVRTDSPNFLCSVLPSHWRCNKTLPVAFKVVALGEVPDGTVVTVMAGNDENYSAELRNASAVMKNQVARFNDLRFVGRSG

SEQ ID NO: 2143 - protein, 255 aa, Homo sapiens
MGDPGSEIIESVPPAGPEASESTTDENEDDIQFVSEGPLRPVLEYIDLVSSDDEEPSTSYTDRMPESKVPSSENHRPEMCSSCNVPLPIGDSSSFSGSCSSSPERIVSQTSSVENPLENQKNDQNNSDTKISETETLKSSQNFQTLPSSPLLVPQESLASSEVKENLRIDSSSASQHGRDAILYLQTQVAEMSRVIRDLQSRSCFRFHHSRPSENSSVPWDISTSKEENLSTVEEETDYKSPSADDKGQPSDPSQ

SEQ ID NO: 2144 - protein, 255 aa, Homo sapiens
MAEMEKEGRPPENKRSRKPAHPVKREINEEMKNFAENTMNELLGWYGYDKVELKDGEDIEFRSYPTDGESRQHISVLKENSLPKPKLPEDSVISPYNISTGYSGLATGNGLSDSPAGSKDHGSVPIIVPLIPPPFIKPPAEDDVSNVQIMCAWCQKVGIKRYSLSMGSEVKSFCSEKCFAACRRAYFKRNKARDEDGHAENFPQQHYAKETPRLAFKNNCELLVCDWCKHIRHTKEYLDFGDGERRLQFCSAKCL

SEQ ID NO: 2145 - protein, 255 aa, Homo sapiens
MDSELMHSIVGSYHKPPERVFVPSFTQNEPSQNCHPANLEVTSPKILHSPNSQALILALKTLQEKIHRLELERTQAEDNLNILSREAAQYKKALENETNERNLAHQELIKQKKDISIQLSSAQSRCTLLEKQLEYTKRMVLNVEREKNMILEQQAQLQREKEQDQMKLYAKLEKLDVLEKECFRLTTTQKTAEDKIKHLEEKLKEEEHQRKLFQDKASELQTGLEISKIIMSSVSNLKHSKEKKKSSKKTKCIKR

SEQ ID NO: 2146 - protein, 255 aa, Homo sapiens
MLCASFLGLGLSVAIVGPTFQDLATNVNRNISSLSFIFVGRALGYLSGSVIGGFLVDVMNYFLLLGISMSATTVGLYLVPFCKTAILLTVMMSIFGVSIGILDTGGNVLILAIWGDKGAPHMQALHFSFALGAFLAPLLAKLALGPTASAENHTESDFHPALNQSSDADSEALFGVPNDKNLLWAYAVIGTYMFLVSVIFFCLFLKNSSKQEKARASAETFRRAKYHNALLCLLFLFFFFYVGAEVTYGSYVFSF

SEQ ID NO: 2147 - protein, 243 aa, Homo sapiens
MTDYGEEQRNELEALESIYPDSFTVLSENPPSFTITVTSEAGENDETVQTTLKFTYSEKYPDEAPLYEIFSQENLEDNDVSDILKLLALQAEENLGMVMIFTLVTAVQEKLNEIVDQIKTRREEEKKQKEKEAEEAEKQLFHGTPVTIENFLNWKAKFDAELLEIKKKRMKEEEQAGKNKLSGKQLFETDHNLDTSDIQFLEDAGNNVEVDESLFQEMDDLELEDDEDDPDYNPADPESDSAD

SEQ ID NO: 2148 - protein, 255 aa, Homo sapiens
MDAMASPGKDNYRMKSYKNKALNPQEMRRRREEEGIQLRKQKREEQLFKRRNVYLPRNDESMLESPIQDPDISSTVPIPEEEVVTTDMVQMIFSNNADQQLTATQKFRKLLSKEPNPPIDQVIQKPGVVQRFVKFLERNENCTLQFEAAWALTNIASGTFLHTKVVIETGAVPIFIKLLNSEHEDVQEQAVWALGNIAGDNAECRDFVLNCEILPPLLELLTNSNRLTTTRNAVWALSNLCRGKNPPPNFSKVSP

SEQ ID NO: 2149 - protein, 175 aa, Homo sapiens
MLSEEEKEELKAELVQLEDEITTLRQVLSAKERHLVEIKQKLGMNLMNELKQNFSKSWHDMQTTTAYKKTHETLSHAGQKATAAFSNVGTAISKKFGDMSYSIRHSISMPAMRNSPTFKSFEERVETTVTSLKTKVGGTNPNGGSFEEVLSSTAHASAQSLAGGSRRTKEEELQC

SEQ ID NO: 2150 - protein, 255 aa, Homo sapiens
MSAKSRTIGIIGAPFSKGQPRGGVEEGPTVLRKAGLLEKLKEQECDVKDYGDLPFADIPNDSPFQIVKNPRSVGKASEQLAGKVAEVKKNGRISLVLGGDHSLAIGSISGHARVHPDLGVIWVDAHTDINTPLTTTSGNLHGQPVSFLLKELKGKIPDVPGFSWVTPCISAKDIVYIGLRDVDPGEHYILKTLGIKYFSMTEVDRLGIGKVMEETLSYLLGRKKRPIHLSFDVDGLDPSFTPATGTPVVGGLTYR

SEQ ID NO: 2151 - protein, 225 aa, Homo sapiens
MAGGGAGDPGLGAAAAPAPETREHLFKVLVIGELGVGKTSIIKRYVHQLFSQHYRATIGVDFALKVLNWDSRTLVRLQLWDIAGQERFGNMTRVYYKEAVGAFVVFDISRSSTFEAVLKWKSDLDSKVHLPNGSPIPAVLLANKCDQNKDSSQSPSQVDQFCKEHGFAGWFETSAKDNINIEEAARFLVEKILVNHQSFPNEENDVDKIKLDQETLRAENKSQCC

SEQ ID NO: 2152 - protein, 255 aa, Homo sapiens
MAHNAGAAAAAGTHSAKSGGSEAALKEGGSAAALSSSSSSSAAAAAASSSSSSGPGSAMETGLLPNHKLKTVGEAPAAPPHQQHHHHHHAHHHHHHAHHLHHHHALQQQLNQFQQQQQQQQQQQQQQQQQQHPISNNNSLGGAGGGAPQPGPDMEQPQHGGAKDSAAGGQADPPGPPLLSKPGDEDDAPPKMGEPAGGRYEHPGLGALGTQQPPVAVPGGGGGPAAVPEFNNYYGSAAPASGGPGGRAGPCFDQH

SEQ ID NO: 2153 - protein, 255 aa, Homo sapiens
MPSFDEALQRVGEFGRFQRRVFLLLCLTGVTFAFLFVGVVFLGTQPDHYWCRGPSAAALAERCGWSPEEEWNRTAPASRGPEPPERRGRCQRYLLEAANDSASATSALSCADPLAAFPNRSAPLVPCRGGWRYAQAHSTIVSEFDLVCVNAWMLDLTQAILNLGFLTGAFTLGYAADRYGRIVIYLLSCLGVGVTGVVVAFAPNFPVFVIFRFLQGVFGKGTWMTCYVIVTEIVGSKQRRIVGIVIQMFFTLGII

SEQ ID NO: 2154 - protein, 255 aa, Homo sapiens
MEQLSSANTRFALDLFLALSENNPAGNIFISPFSISSAMAMVFLGTRGNTAAQLSKTFHFNTVEEVHSRFQSLNADINKRGASYILKLANRLYGEKTYNFLPEFLVSTQKTYGADLASVDFQHASEDARKTINQWVKGQTEGKIPELLASGMVDNMTKLVLVNAIYFKGNWKDKFMKEATTNAPFRLNKKDRKTVKMMYQKKKFAYGYIEDLKCRVLELPYQGEELSMVILLPDDIEDESTGLKKIEEQLTLEKL

SEQ ID NO: 2155 - protein, 255 aa, Homo sapiens
MGRRNENCANSLRVSNISQENLSHWNLDSEVPVSENKNLPAGRDGAAGGKINKNYLEIPVEQLMLEPNLSVHSQKSTQNSKQGIFQLWNCPLNEGSTIEKREFKKSSVETGFNVINHPIRVFTLNHPLTIASVDKQVGPYPGLPMPLGLCWPYADGDFFKNRNEIHVSSCSTIENNDGETLPAPNWNLKHGNSSVEENFTDESDLSENEKTNDTLLSYFKKVDLNLKPETIKNVEEPFTEEPNEVFPYPDFLPPP

SEQ ID NO: 2156 - protein, 255 aa, Homo sapiens
MQAKNKDALQPIKEDRTGKAQDDAFWLQSLITDAFHDKGFQKIKEYFQQKESHFPQKYNRLLLYRLDRSINKELDKNEFQSVSLLLKCIQRFLVDGLKEDEPLLIRQGLIPKLVSWFERTTGILTSEGLASDTSLICVIEDFFDTALIISRSSSEGKIQMLDSFLLSLGFLVTEKTVNHLLQQEGLKTFNCILHAVPREERKKFPLSEGMCHLMKDLARTLLTVGDYDQQVAISEALCRLTIKKSRDELVHKWFD

SEQ ID NO: 2157 - protein, 255 aa, Homo sapiens
MKSNQERSNECLPPKKREIPATSRSSEEKAPTLPSDNHRVEGTAWLPGNPGGRGHGGGRHGPAGTSVELGLQQGIGLHKALSTGLDYSPPSAPRSVPVATTLPAAYATPQPGTPVSPVQYAHLPHTFQFIGSSQYSGTYASFIPSQLIPPTANPVTSAVASAAGATTPSQRSQLEAYSTLLANMGSLSQTPGHKAEQQQQQQQQQQQQHQHQQQQQQQQQQQQQQHLSRAPGLITPGSPPPAQQNQYVHISSSPQ

SEQ ID NO: 2158 - protein, 476 aa, Homo sapiens [sequence omitted]

SEQ ID NO: 2159 - protein, 136 aa, Homo sapiens
MARTKQTARKSTGGKAPRKQLATKAARKSAPATGGVKKPHRYRPGTVALREIRRYQKSTELLIRKLPFQRLVREIAQDFKTDLRFQSSAVMALQEACEAYLVGLFEDTNLCAIHAKRVTIMPKDIQLARRIRGERA

SEQ ID NO: 2160 - protein, 103 aa, Homo sapiens [sequence omitted]

SEQ ID NO: 2161 - protein, 961 aa, Homo sapiens
MLLLLLLAPLFLRPPGAGGAQTPNATSEGCQIIHPPWEGGIRYRGLTRDQVKAINFLPVDYEIEYVCRGEREVVGPKVRKCLANGSWTDMDTPSRCVRICSKSYLTLENGKVFLTGGDLPALDGARVDFRCDPDFHLVGSSRSICSQGQWSTPKPHCQVNRTPHSERRAVYIGALFPMSGGWPGGQACQPAVEMALEDVNSRRDILPDYELKLIHHDSKCDPGQATKYLYELLYNDPIKIILMPGCSSVSTLVAEAARMWNLIVLSYGSSSPALSNRQRFPTFFRTHPSATLHNPTRVKLFEKWGWKKIATIQQTTEVFTSTLDDLEERVKEAGIEITFRQSFFSDPAVPVKNLKRQDARIIVGLFYETEARKVFCEVYKERLFGKKYVWFLIGWYADNWFKIYDPSINCTVDEMTEAVEGHITTEIVMLNPANTRSISNMTSQEFVEKLTKRLKRHPEETGGFQEAPLAYDAIWALALALNKTSGGGGRSGVRLEDFNYNNQTITDQIYRAMNSSSFEGVSGHVVFDASGSRMAWTLIEQLQGGSYKKIGYYDSTKDDLSWSKTDKWIGGSPPADQTLVIKTFRFLSQKLFISVSVLSSLGIVLAVVCLSFNIYNSHVRYIQNSQPNLNNLTAVGCSLALAAVFPLGLDGYHIGRNQFPFVCQARLWLLGLGFSLGYGSMFTKIWWVHTVFTKKEEKKEWRKTLEPWKLYATVGLLVGMDVLTLAIWQIVDPLHRTIETFAKEEPKEDIDVSILPQLEHCSSRKMNTWLGIFYGYKGLLLLLGIFLAYETKSVSTEKINDHRAVGMAIYNVAVLCLITAPVTMILSSQQDAAFAFASLAIVFSSYITLVVLFVPKMRRLITRGEWQSEAQDTMKTGSSTNNNEEEKSRLLEKENRELEKIIAEKEERVSELRHQLQSRQQLRSRRHPPTPPEPSGGLPRGPPEPPDRLSCDGSRVHLLYK

SEQ ID NO: 2162 - protein, 285 aa, Homo sapiens
MGTPGEGLGRCSHALIRGVPESLASGEGAGAGLPALDLAKAQREHGVLGGKLRQRLGLQLLELPPEESLPLGPLLGDTAVIQGDTALITRPWSPARRPEVDGVRKALQDLGLRIVEIGDENATLDGTDVLFTGREFFVGLSKWTNHRGAEIVADTFRDFAVSTVPVSGPSHLRGLCGMGGPRTVVAGSSDAAQKAVRAMAVLTDHPYASLTLPDDAAADCLFLRPGLPGVPPFLLHRGGGDLPNSQEALQKLSDVTLVPVSCSELEKAGAGLSSLCLVLSTRPHS

SEQ ID NO: 2163 - protein, 241 aa, Homo sapiens
MAEEQPQVELFVKAGSDGAKIGNCPFSQRLFMVLWLKGVTFNVTTVDTKRRTETVQKLCPGGQLPFLLYGTEVHTDTNKIEEFLEAVLCPPRYPKLAALNPESNTAGLDIFAKFSAYIKNSNPALNDNLEKGLLKALKVLDNYLTSPLPEEVDETSAEDEGVSQRKFLDGNELTLADCNLLPKLHIVQVVCKKYRGFTIPEAFRGVHRYLSNAYAREEFASTCPDDEEIELAYEQVAKALK

SEQ ID NO: 2164 - protein, 255 aa, Homo sapiens
MTGERPSTALPDRRWGPRILGFWGGCRVWVFAAIFLLLSLAASWSKAENDFGLVQPLVTMEQLLWVSGRQIGSVDTFRIPLITATPRGTLLAFAEARKMSSSDEGAKFIALRRSMDQGSTWSPTAFIVNDGDVPDGLNLGAVVSDVETGVVFLFYSLCAHKAGCQVASTMLVWSKDDGVSWSTPRNLSLDIGTEVFAPGPGSGIQKQREPRKGRLIVCGHGTLERDGVFCLLSDDHGASWRYGSGVSGIPYGQPK

SEQ ID NO: 2165 - protein, 255 aa, Homo sapiens
MSWAARPPFLPQRHAAGQCGPVGVRKEMHCGVASRWRRRRPWLDPAAAAAAAVAGGEQQTPEPEPGEAGRDGMGDSGRDSRSPDSSSPNPLPQGVPPPSPPGPPLPPSTAPSLGGSGAPPPPPMPPPPLGSPFPVISSSMGSPGLPPPAPPGFSGPVSSPQINSTVSLPGGGSGPPEDVKPPVLGVRGLHCPPPPGGPGAGKRLCAICGDRSSGKHYGVYSCEGCKGFFKRTIRKDLTYSCRDNKDCTVDKRQRN

SEQ ID NO: 2166 - protein, 255 aa, Homo sapiens
MAAAATMAAAARELVLRAGTSDMEEEEGPLAGGPGLQEPLQLGELDITSDEFILDEVDVHIQANLEDELVKEALKTGVDLRHYSKQVELELQQIEQKSIRDYIQESENIASLHNQITACDAVLERMEQMLGAFQSDLSSISSEIRTLQEQSGAMNIRLRNRQAVRGKLGELVDGLVVPSALVTAILEAPVTEPRFLEQLQELDAKAAAVREQEARGTAACADVRGVLDRLRVKAVTKIREFILQKIYSFRKPMTN

SEQ ID NO: 2167 - protein, 255 aa, Homo sapiens
MNCDYYMEEKVLPPSSLEGKVKETVHNAFWDHLKEQLSATPPDFSCALELLKEIKEILLSLLLPRQNRLRIEIEEALDMDLLKQEAEHGALKVLYLSKYVLNMMALLCAPVRDEAVQKLENITDPVWLLRGIFQVLGRMKMDMVNYTIQSLQPHLQEHSIQYERAKFQELLNKQPSLLNHTTKWLTQAAGDLTMSPPTCPDTSDSSSVAGPSPNEAANNPEPLSPTMVLCQGFLNLLLWDLENEEFPETLLMDRT

SEQ ID NO: 2168 - protein, 98 aa, Homo sapiens
MILLPQPPKKLGLQENGELCMNSAQCKSNCCQHSSALGLARCTSMASENSECSVKTLYGIYYKCPCERGLTCEGDKTIVGSITNTNFGICHDAGRSKQ

SEQ ID NO: 2169 - protein, 255 aa, Homo sapiens
MKWMVVVLVCLQLLEAAVVKVPLKKFKSIRETMKEKGLLGEFLRTHKYDPAWKYRFGDLSVTYEPMAYMDAAYFGEISIGTPPQNFLVLFDTGSSNLWVPSVYCQSQACTSHSRFNPSESSTYSTNGQTFSLQYGSGSLTGFFGYDTLTVQSIQVPNQEFGLSENEPGTNFVYAQFDGIMGLAYPALSVDEATTAMQGMVQEGALTSPVFSVYLSNQQGSSGGAVVFGGVDSSLYTGQIYWAPVTQELYWQIGIE

SEQ ID NO: 2170 - protein, 255 aa, Homo sapiens
MYRSSARSSVSSHRPKDDGGGGPRSGRSSGSSSGPARRSSPPPPPSGSSSRTPARRPRSPSGHRGRRASPSPPRGRRVSPSPPRARRGSPSPPRGRRLFPPGPAGFRGSSRGESRADYARDGRGDHPGDSGSRRRSPGLCSDSLEKSLRITVGNDHFCVSTPERRRLSDRLGSPVDNLEDMDRDDLTDDSVFTRSSQCSRGLERYISQEEGPLSPFLGQLDEDYRTKETFLHRSDYSPHISCHDELLRGTERNRE

SEQ ID NO: 2171 - protein, 255 aa, Homo sapiens
MATTAAPAGGARNGAGPEWGGFEENIQGGGSAVIDMENMDDTSGSSFEDMGELHQRLREEEVDADAADAAAAEEEDGEFLGMKGFKGQLSRQVADQMWQAGKRQASRAFSLYANIDILRPYFDVEPAQVRSRLLESMIPIKMVNFPQKIAGELYGPLMLVFTLVAILLHGMKTSDTIIREGTLMGTAIGTCFGYWLGVSSFIYFLAYLCNAQITMLQMLALLGYGLFGHCIVLFITYNIHLHALFYLFWLLVGGL

SEQ ID NO: 2172 - protein, 145 aa, Homo sapiens [sequence omitted]

SEQ ID NO: 2173 - protein, 255 aa, Homo sapiens
MVPPKLHVLFCLCGCLAVVYPFDWQYINPVAHMKSSAWVNKIQVLMAAASFGQTKIPRGNGPYSVGCTDLMFDHTNKGTFLRLYYPSQDNDRLDTLWIPNKEYFWGLSKFLGTHWLMGNILRLLFGSMTTPANWNSPLRPGEKYPLVVFSHGLGAFRTLYSAIGIDLASHGFIVAAVEHRDRSASATYYFKDQSAAEIGDKSWLYLRTLKQEEETHIRNEQVRQRAKECSQALSLILDIDHGKPVKNALDLKFDM

SEQ ID NO: 2174 - protein, 255 aa, Homo sapiens
MTAWLISLMSIEVLLLAVRHLSLHIEPEEGSLAGGTWITVIFDGLELGVLYPNNGSQLEIHLVNVNMVVPALRSVPCDVFPVFLDLPVVTCRTRSVLSEAHEGLYFLEAYFGGQLVSSPNPGPRDSCTFKFSKAQTPIVHQVYPPSGVPGKLIHVYGWIITGRLETFDFDAEYIDSPVILEAQGDKWVTPCSLINRQMGSCYPIQEDHGLGTLQCHVEGDYIGSQNVSFSVFNKGKSMVHKKAWLISAKQDLFLY

SEQ ID NO: 2175 - protein, 163 aa, Homo sapiens
MTVKTLHGPAMVKYLLLSILGLAFLSEAAARKIPKVGHTFFQKPESCPPVPGGSMKLDIGIINENQRVSMSRNIESRSTSPWNYTVTWDPNRYPSEVVQAQCRNLGCINAQGKEDISMNSVPIQQETLVVRRKHQGCSVSFQLEKVLVTVGCTCVTPVIHHVQ

SEQ ID NO: 2176 - protein, 255 aa, Homo sapiens
MEEPGAQCAPPPPAGSETWVPQANLSSAPSQNCSAKDYIYQDSISLPWKVLLVMLLALITLATTLSNAFVIATVYRTRKLHTPANYLIASLAVTDLLVSILVMPISTMYTVTGRWTLGQVVCDFWLSSDITCCTASILHLCVIALDRYWAITDAVEYSAKRTPKRAAVMIALVWVFSISISLPPFFWRQAKAEEEVSECVVNTDHILYTVYSTVGAFYFPTLLLIALYGRIYVEARSRILKQTPNRTGKRLTRAQ

SEQ ID NO: 2177 - protein, 255 aa, Homo sapiens
MPYFTRLILFLFCLMVLVESRKPKRKRWTGQVEMPKPSHLYKKNLDVTKIRKGKPQQLLRVDEHDFSMRPAFGGPAIPVGVDVQVESLDSISEVDMDFTMTLYLRHYWKDERLAFSSASNKSMTFDGRLVKKIWVPDVFFVHSKRSFTHDTTTDNIMLRVFPDGHVLYSMRITVTAMCNMDFSHFPLDSQTCSLELESYAYTDEDLMLYWKNGDESLKTDEKISLSQFLIQKFHTTSRLAFYSSTGWYNRLYINF

SEQ ID NO: 2178 - protein, 255 aa, Homo sapiens
METRYNLKSPAVKRLMKEAAELKDPTDHYHAQPLEDNLFEWHFTVRGPPDSDFDGGVYHGRIVLPPEYPMKPPSIILLTANGRFEVGKKICLSISGHHPETWQPSWSIRTALLAIIGFMPTKGEGAIGSLDYTPEERRALAKKSQDFCCEGCGSAMKDVLLPLKSGSDSSQADQEAKELARQISFKAEVNSSGKTISESDLNHSFSLTDLQDDIPTTFQGATASTSYGLQNSSAASFHQPTQPVAKNTSMSPRQR

SEQ ID NO: 2179 - protein, 255 aa, Homo sapiens
MSVDEKPDSPMYVYESTVHCTNILLGLNDQRKKDILCDVTLIVERKEFRAHRAVLAACSEYFWQALVGQTKNDLVVSLPEEVTARGFGPLLQFAYTAKLLLSRENIREVIRCAEFLRMHNLEDSCFSFLQTQLLNSEDGLFVCRKDAACQRPHEDCENSAGEEEDEEEETMDSETAKMACPRDQMLPEPISFEAAAIPVAEKEEALLPEPDVPTDTKESSEKDALTQYPRYKKYQLACTKNVYNASSHSTSGFAS

SEQ ID NO: 2180 - protein, 204 aa, Homo sapiens
MAKVQVNNVVVLDNPSPFYNPFQFEITFECIEDLSEDLEWKIIYVGSAESEEYDQVLDSVLVGPVPAGRHMFVFQADAPNPGLIPDADAVGVTVVLITCTYRGQEFIRVGYYVNNEYTETELRENPPVKPDFSKLQRNILASNPRVTRFHINWEDNTEKLEDAESSNPNLQSLLSTDALPSASKGWSTSENSLNVMLESHMDCM

SEQ ID NO: 2181 - protein, 255 aa, Homo sapiens
MTTQLPAYVAILLFYVSRASCQDTFTAAVYEHAAILPNATLTPVSREEALALMNRNLDILEGAITSAADQGAHIIVTPEDAIYGWNFNRDSLYPYLEDIPDPEVNWIPCNNRNRFGQTPVQERLSCLAKNNSIYVVANIGDKKPCDTSDPQCPPDGRYQYNTDVVFDSQGKLVARYHKQNLFMGENQFNVPKEPEIVTFNTTFGSFGIFTCFDILFHDPAVTLVKDFHVDTIVFPTAWMNVLPHLSAVEFHSAWA

SEQ ID NO: 2182 - protein, 255 aa, Homo sapiens
MRAPGRPALRPLPLPPLLLLLLAAPWGRAVPCVSGGLPKPANITFLSINMKNVLQWTPPEGLQGVKVTYTVQYFIYGQKKWLNKSECRNINRTYCDLSAETSDYEHQYYAKVKAIWGTKCSKWAESGRFYPFLETQIGPPEVALTTDEKSISVVLTAPEKWKRNPEDLPVSMQQIYSNLKYNVSVLNTKSNRTWSQCVTNHTLVLTWLEPNTLYCVHVESFVPGPPRRAQPSEKQCARTLKDQSSEFKAKIIFWY

SEQ ID NO: 2183 - protein, 154 aa, Homo sapiens
MEKDDSRDISLGGCGSCLWTHWFIYQNMALLCYRFCILGQKTTRLLTRWPLVWHPLARRVLLHLTEKAGRSDYCYIWLKFLFLCNLVMQYTWRSIYIIKLLIHFISNILLTENIYCLGFSLDHLDKCRIPLKLTTMRKLTKQVICQKLKSEKLC

SEQ ID NO: 2184 - protein, 255 aa, Homo sapiens
MSSPGTESAGKSLQYRVDHLLSAVENELQAGSEKGDPTERELRVGLEESELWLRFKELTNEMIVTKNGRRMFPVLKVNVSGLDPNAMYSFLLDFVAADNHRWKYVNGEWVPGGKPEPQAPSCVYIHPDSPNFGAHWMKAPVSFSKVKLTNKLNGGGQIMLNSLHKYEPRIHIVRVGGPQRMITSHCFPETQFIAVTAYQNEEITALKIKYNPFAKAFLDAKERSDHKEMMEEPGDSQQPGYSQWGWLLPGTSTLC

SEQ ID NO: 2185 - protein, 255 aa, Homo sapiens
MDLSMKKFAVRRFFSVYLRRKSRSKSSSLSRLEEEGVVKEIDISHHVKEGFEKADPSQFELLKVLGQGSYGKVFLVRKVKGSDAGQLYAMKVLKKATLKVRDRVRSKMERDILAEVNHPFIVKLHYAFQTEGKLYLILDFLRGGDLFTRLSKEVMFTEEDVKFYLAELALALDHLHSLGIIYRDLKPENILLDEEGHIKITDFGLSKEAIDHDKRAYSFCGTIEYMAPEVVNRRGHTQSADWWSFGVLMFEMLTG

SEQ ID NO: 2186 - protein, 171 aa, Homo sapiens
MTPTAFFSSPNTAGGMTPTASSSQHTAGGMTPTVFSSQHTAGGMTPTVFSSQHTAGGMTPTASSSQHTAGGMTPTVFSSPHTAGGMTPTVFSSPHTAGGMTPTVFSSPHTAGGMTPTASSSQHTAGVMTPTASSFPTHCRGNDPHCLLLPQHCRGNDPHCLLLPTHTLQGE

SEQ ID NO: 2187 - protein, 255 aa, Homo sapiens
MDFSRLHMYSPPQCVPENTGYTYALSSSYSSDALDFETEHKLDPVFDSPRMSRRSLRLATTACTLGDGEAVGADSGTSSAVSLKNRAARTTKQRRSTNKSAFSINHVSRQVTSSGVSHGGTVSLQDAVTRRPPVLDESWIREQTTVDHFWGLDDDGDLKGGNKAAIQGNGDVGAAAATAHNGFSCSNCSMLSERKDVLTAHPAAPGPVSRVYSRDRNQKCYFLLQILRRIGAVGQAVSRTAWSALWLAVVAPGKA

SEQ ID NO: 2188 - protein, 255 aa, Homo sapiens
MQVRELPRGEWQTYSSSISHEATACVVDRLRPFTSYKLRLKATNDIGDSDFSSETEAVTTLQDVPGEPPGSVSATPHTTSSVLIQWQPPRDESLNGLLQGYRIYYRELEYEAGSGTEAKTLKNPIALHAELTAQSSFKTVNSSSTSTMCELTHLKKYRRYEVIMTAYNIIGESPASAPVEVFVGEAAPAMAPQNVQVTPLTASQLEVTWDPPPPESQNGNIQGYKIYYWEADSQNETEKMKVLFLPEPVVRLKNL

SEQ ID NO: 2189 - protein, 255 aa, Homo sapiens
MDFLVLFLFYLASVLMGLVLICVCSKTHSLKGLARGGAQIFSCIIPECLQRAVHGLLHYLFHTRNHTFIVLHLVLQGMVYTEYTWEVFGYCQELELSLHYLLLPYLLLGVNLFFFTLTCGTNPGIITKANELLFLHVYEFDEVMFPKNVRCSTCDLRKPARSKHCSVCNWCVHRFDHHCVWVNNCIGAWNIRYFLIYVLTLTASAATVAIVSTTFLVHLVVMSDLYQETYIDDLGHLHVMDTVFLIQYLFLTFPR

SEQ ID NO: 2190 - protein, 589 aa, Homo sapiens
MSDIRHSLLRRDALSAAKEVLYHLDIYFSSQLQSAPLPIVDKGPVELLEEFVFQVPKERSAQPKRLNSLQELQLLEIMCNYFQEQTKDSVRQIIFSSLFSPQGNKADDSRMSLLGKLVSMAVAVCRIPVLECAASWLQRTPVVYCVRLAKALVDDYCCLVPGSIQTLKQIFSASPRFCCQFITSVTALYDLSSDDLIPPMDLLEMIVTWIFEDPRLILITFLNTPIAANLPIGFLELTPLVGLIRWCVKAPLAYKRKKKPPLSNGHVSNKVTKDPGVGMDRDSHLLYSKLHLSVLQVLMTLQLHLTEKNLYGRLGLILFDHMVPLVEEINRLADELNPLNASQEIELSLDRLAQALQVAMASGALLCTRDDLRTLCSRLPHNKTLNFGVVCKASFLGLLLGIQPPPAGDLGSRAAVASRRAPPGVLPPHPHAPAGLRGCPGPPRRPPRPAHASRPHLHLRRDLSLQAHPLGWPVCAFCALAGRSLSRWKGWPDSQKRTSGKGSGSPSPPAEPSWCHGVQVLPTRSHSLTCRLDGGGKSPASAESLLRAFLKDADPGSLCSLRISDTACVARSVTAGATGASPCVWPLSS

SEQ ID NO: 2191 - protein, 255 aa, Homo sapiens
MSTASSSSSSSSSQTPHPPSQRMRRSAAGSPPAVAAAGSGNGAGGGGGVGCAPAAGAGRLLQPIRATVPYQLLRGSQHSPTRPPVAAAAASLGSLPGPGAARGPSPSSPTPPAAAAPAEQAPRAKGRPRRSPESHRRSSSPERRSPGSPVCRADKAKSQQVRTSSTIRRTSSLDTITGPYLTGQWPRDPHVHYPSCMKDKATQTPSCWAEEGAEKRSHQRSASWGSADQLKEQIAKLRQQLQRSKQSSRHSKEKD

SEQ ID NO: 2192 - protein, 255 aa, Homo sapiens
MECLYYFLGFLLLAARLPLDAAKRFHDVLGNERPSAYMREHNQLNGWSSDENDWNEKLYPVWKRGDMRWKNSWKGGRVQAVLTSDSPALVGSNITFAVNLIFPRCQKEDANGNIVYEKNCRNEAGLSADPYVYNWTAWSEDSDGENGTGQSHHNVFPDGKPFPHHPGWRRWNFIYVFHTLGQYFQKLGRCSVRVSVNTANVTLGPQLMEVTVYRRHGRAYVPIAQVKDVYVVTDQIPVFVTMFQKNDRNSSDETF

SEQ ID NO: 2193 - protein, 140 aa, Homo sapiens
MFFTISRKNMSQKLSLLLLVFGLIWGLMLLHYTFQQPRHQSSVKLREQILDLSKRYVKALAEENKNTVDVENGASMAGYADLKRTIAVLLDDILQRLVKLENKVDYIVVNGSAANTTNGTSGNLVPVTTNKRTNVSGSIR

SEQ ID NO: 2194 - protein, 255 aa, Homo sapiens
MPVPPPPPPPLPPPPPPLGAPPPPPPSAPPVSTDTSSLRRADPKGRSALLADIQQGTRLRKVTQINDRSAPQIESSKGTNKEGGGSANTRGASTPPTLGDLFAGGFPVLRPAGQRDVAGGKTGQGPGSRAPSPRLPNKTISGPLIPPASPRLGNTSEAHGAARTAPPRPNVPAPPPPTPPPPPPPLPPPLPSSSPIKTPLVSPPGPLTKGNLPVVAPPVPCAPPPPPPPPPPTPPPLPPASVLSDKAVKPQLAPL

SEQ ID NO: 2195 - protein, 255 aa, Homo sapiens
MPGHNTSRNSSCDPIVTPHLISLYFIVLIGGLVGVISILFLLVKMNTRSVTTMAVINLVVVHSVFLLTVPFRLTYLIKKTWMFGLPFCKFVSAMLHIHMYLTFLFYVVILVTRYLIFFKCKDKVEFYRKLHAVAASAGMWTLVIVIVVPLVVSRYGIHEEYNEEHCFKFHKELAYTYVKIINYMIVIFVIAVAVILLVFQVFIIMLMVQKLRHSLLSHQEFWAQLKNLFFIGVILVCFLPYQFFRIYYLNVVTHS

SEQ ID NO: 2196 - protein, 234 aa, Homo sapiens
MNHLPEDMENALTGSQSSHASLRNIHSINPTQLMARIESYEGREKKGISDVRRTFCLFVTFDLLFVTLLWIIELNVNGGIENTLEKEVMQYDYYSSYFDIFLLAVFRFKVLILAYAVCRLRHWWAIALTTAVTSAFLLAKVILSKLFSQGAFGYVLPIISFILAWIETWFLDFKVLPQEAEEENRLLIVQDASERAALIPGGLSDGQFYSPPESEAGSEEAEEKQDSEKPLLEL

SEQ ID NO: 2197 - protein, 255 aa, Homo sapiens
MSALLQDPMIAGQVSKPLLSVRSEMNAELRGEDKAATSDSELNEPLLAPVESNDSEDTPSKLFGARGNPALSDPGTPDQHQASQTHPPFPVGPQPLLTAQQLASAVAGVMPGGPPALNQPILIPFNMAGQLGGQQGLVLTLPTANLTNIQGLVAAAAAGGIMTLPLQNLQATSSLNSQLQQLQLQLQQQQQQQQQQPPPSTNQHPQPAPQAPSQSQQQPLQPTPPQQPPPASQQPPAPTSQLQQAPQPQQHQPHS

SEQ ID NO: 2198 - protein, 255 aa, Homo sapiens
MPSSSDTALGGGGGLSWAEKKLEERRKRRRFLSPQQPPLLLPLLQPQLLQPPPPPPPLLFLAAPGTAAAAAAAAAASSSCFSPGPPLEVKRLARGKRRAGGRQKRRRGPRAGQEAEKRRVFSLPQPQQDGGGGASSGGGVTPLVEYEDVSSQSEQGLLLGGASAATAATAAGGTGGSGGSPASSSGTQRRGEGSERRPRRDRRSSSGRSKERHREHRRRDGQRGGSEASKSRSRHSHSGEERAEVAKSGSSSSSG

SEQ ID NO: 2199 - protein, 255 aa, Homo sapiens
MNSMNPMKPALPPAPHGDGSFAYESVPWQQSATQPAGSLSVVTTVWGVGNATQSQVLGNPMGPAGSPSGSSMMPGVAGGSSALTSPQCLGQQAFAEGGANKGYVQQGVYSRGGYPGAPGFTTGYAGGPGGLGLPSHAARPSTDFTQAAAAAAVAAAAATATATATATVAALQEKQSQELSQYGAMGAGQSFNSQFLQHGGPRGPSVPAGMNPTGIGGVMGPSGLSPLAMNPTRAAGMTPLYAGQRLPQHGYPGPP

SEQ ID NO: 2200 - protein, 255 aa, Homo sapiens
MAATGANAEKAESHNDCPVRLLNPNIAKMKEDILYHFNLTTSRHNFPALFGDVKFVCVGGSPSRMKAFIRCVGAELGLDCPGRDYPNICAGTDRYAMYKVGPVLSVSHGMGIPSISIMLHELIKLLYYARCSNVTIIRIGTSGGIGLEPGTVVITEQAVDTCFKAEFEQIVLGKRVIRKTDLNKKLVQELLLCSAELSEFTTVVGNTMCTLDFYEGQGRLDGALCSYTEKDKQAYLEAAYAAGVRNIEMESSVFA

SEQ ID NO: 2201 - protein, 504 aa, Homo sapiens
MLDNYRNLVFLGIAVSKPDLITCLEQGKEPCNMKRHAMVAKPPVVCSHFAQDLWPKQGLKDSFQKVILRRYGKYGHENLQLRKGCKSADEHKVHKRGYNGLNQCLTTTQSKIFQCDKYVKVLHKFSNSNIHKKRQTGKKPFKCKECGKSCCILSQLTQHKKTATRVNFYKCKTCGKAFNQFSNLTKHKIIHPEVNPYKCEECGKAFNQSLTLTKHKKIHTEEKPYKCEDCGKVFSVFSVLTKHKIIHTGTKPYNCEECGKGFSIFSTLTKHKIIHTGEKPYKCNECGKAFNWSSTLTKHKRIHTGEKPYKCEECGKAFNQSSTLTRHKIVHTGEKPYKCEECGKAFKRSTTLTKHKRIYTKEKPYKCEECGKAFSVFSTLTKHKIIHTGAKPYKCEECGSAFRAFSTLTEHKRVHTGEKPYKCNECGKAFNWSSTLTKHKRIHTGEKPYKCEECGKAFNRSSNLTRHKKIHTGEKPYKPKRCDSAFDNTPNFSRHKRNHMGEKS

SEQ ID NO: 2202 - protein, 255 aa, Homo sapiens
MVVVTGREPDSRRQDGAMSSSDAEDDFLEPATPTATQAGHALPLLPQEFPEVVPLNIGGAHFTTRLSTLRCYEDTMLAAMFSGRHYIPTDSEGRYFIDRDGTHFGDVLNFLRSGDLPPRERVRAVYKEAQYYAIGPLLEQLENMQPLKGEKVRQAFLGLMPYYKDHLERIVEIARLRAVQRKARFAKLKVCVFKEEMPITPYECPLLNSLRFERSESDGQLFEHHCEVDVSFGPWEAVADVYDLLHCLVTDLSAQ

SEQ ID NO: 2203 - protein, 255 aa, Homo sapiens
MSLKSERRGIHVDQSDLLCKKGCGYYGNPAWQGFCSKCWREEYHKARQKQIQEDWELAERLQREEEEAFASSQSSQGAQSLTFSKFEEKKTNEKTRKVTTVKKFFSASSRVGSKKEIQEAKAPSPSINRQTSIETDRVSKEFIEFLKTFHKTGQEIYKQTKLFLEGMHYKRDLSIEEQSECAQDFYHNVAERMQTRGKVPPERVEKIMDQIEKYIMTRLYKYVFCPETTDDEKKDLAIQKRIRALRWVTPQMLCV

SEQ ID NO: 2204 - protein, 255 aa, Homo sapiens
MQKIKSLMTRQGLKSPQESLSDLGAIESLRVPGKEEFRELREQPSDPQAEQELINSIEQVYFSVDSFDIVKYELEKLPPVLNLQELEAYRDKLKQQQAAVSKKVADLILEKQPAYVKELERVTSLQTGLQLAAVICTNGRRHLNIAKEGFTQASLGLLANQRKRQLLIGLLKSLRTIKTLQRTDVRLSEMLEEEDYPGAIQLCLECQKAASTFKHYSCISELNSKLQDTLEQIEEQLDVALSKICKNFDINHYTK

SEQ ID NO: 2205 - protein, 255 aa, Homo sapiens
MRTEAQVPALQPPEPGLEGAMGHRTLVLPWVLLTLCVTAGTPEVWVQVRMEATELSSFTIRCGFLGSGSISLVTVSWGGPNGAGGTTLAVLHPERGIRQWAPARQARWETQSSISLILEGSGASSPCANTTFCCKFASFPEGSWEACGSLPPSSDPGLSAPPTPAPILRADLAGILGVSGVLLFGCVYLLHLLRRHKHRPAPRLQPSRTSPQAPRARAWAPSQASQAALHVPYATINTSCRPATLDTAHPHGGPS

SEQ ID NO: 2206 - protein, 227 aa, Homo sapiens
MGRPLLLPLLLLLQPPAFLQPGGSTGSGPSYLYGVTQPKHLSASMGGSVEIPFSFYYPWELAIVPNVRISWRRGHFHGQSFYSTRPPSIHKDYVNRLFLNWTEGQESGFLRISNLRKEDQSVYFCRVELDTRRSGRQQLQSIKGTKLTITQAVTTTTTWRPSSTTTIAGLRVTESKGHSESWHLSLDTAIRVALAVAVLKTVILGLLCLLLLWWRRRKGSRAPSSDF

SEQ ID NO: 2207 - protein, 255 aa, Homo sapiens
MNLLYRKTKLEWRQHKEEEAKRSSSKEVAPAGSAGPAAGQGPGVRVRDIASLRRSLRMGFMTMPASQEHTPHPCRSAMAPRSLSCHSVGSMDSVGGGPGGASGGLTEDSSTRRPPAKPRRHPSTKLSMVGPGSGAETPPSKKAGSQKPTPEGRESSRKVPPQKPRRSPNTQLSVSFDESCPPGPSPRGGNLPLQRLTRGSRVAGDPDVGAQEEPVYIEMVGDVFRGGGRSGGGLAGPPLGGGGPTPPAGADSDSE

SEQ ID NO: 2208 - protein, 255 aa, Homo sapiens
MSELEQLRQEAEQLRNQIRDARKACGDSTLTQITAGLDPVGRIQMRTRRTLRGHLAKIYAMHWGTDSRLLVSASQDGKLIIWDSYTTNKVHAIPLRSSWVMTCAYAPSGNFVACGGLDNICSIYSLKTREGNVRVSRELPGHTGYLSCCRFLDDNQIITSSGDTTCALWDIETGQQTVGFAGHSGDVMSLSLAPDGRTFVSGACDASIKLWDVRDSMCRQTFIGHESDINAVAFFPNGYAFTTGSDDATCRLFDL

SEQ ID NO: 2209 - protein, 255 aa, Homo sapiens
MRVVTIVILLCFCKAAELRKASPGSVRSRVNHGRAGGGRRGSNPVKRYAPGLPCDVYTYLHEKYLDCQERKLVYVLPGWPQDLLHMLLARNKIRTLKNNMFSKFKKLKSLDLQQNEISKIESEAFFGLNKLTTLLLQHNQIKVLTEEVFIYTPLLSYLRLYDNPWHCTCEIETLISMLQIPRNRNLGNYAKCESPQEQKNKKLRQIKSEQLCNEEEKEQLDPKPQVSGRPPVIKPEVDSTFCHNYVFPIQTLDCK

SEQ ID NO: 2210 - protein, 255 aa, Homo sapiens
MKDMPLRIHVLLGLAITTLVQAVDKKVDCPRLCTCEIRPWFTPRSIYMEASTVDCNDLGLLTFPARLPANTQILLLQTNNIAKIEYSTDFPVNLTGLDLSQNNLSSVTNINVKKMPQLLSVYLEENKLTELPEKCLSELSNLQELYINHNLLSTISPGAFIGLHNLLRLHLNSNRLQMINSKWFDALPNLEILMIGENPIIRIKDMNFKPLINLRSLVIAGINLTEIPDNALVGLENLESISFYDNRLIKVPHVA

SEQ ID NO: 2211 - protein, 255 aa, Homo sapiens
MQRSPLEKASVVSKLFFSWTRPILRKGYRQRLELSDIYQIPSVDSADNLSEKLEREWDRELASKKNPKLINALRRCFFWRFMFYGIFLYLGEVTKAVQPLLLGRIIASYDPDNKEERSIAIYLGIGLCLLFIVRTLLLHPAIFGLHHIGMQMRIAMFSLIYKKTLKLSSRVLDKISIGQLVSLLSNNLNKFDEGLALAHFVWIAPLQVALLMGLIWELLQASAFCGLGFLIVLALFQAGLGRMMMKYRDQRAGKI

SEQ ID NO: 2212 - protein, 96 aa, Homo sapiens
MTSALENYINRTVAVITSDGRMIVGTLKGFDQTINLILDESHERVFSSSQGVEQVVLGLYIVRGDNVAVIGEIDEETDSALDLGNIRAEPLNSVAH

SEQ ID NO: 2213 - protein, 255 aa, Homo sapiens
MSAQAQMRAMLDQLMGTSRDGDTTRQRIKFSDDRVCKSHLLNCCPHDVLSGTRMDLGECLKVHDLALRADYEIASKEQDFFFELDAMDHLQSFIADCDRRTEVAKKRLAETQEEISAEVAAKAERVHELNEEIGKLLAKVEQLGAEGNVEESQKVMDEVEKARAKKREAEEVYRNSMPASSFQQQKLRVCEVCSAYLGLHDNDRRLADHFGGKLHLGFIEIREKLEELKRVVAEKQEKRNQERLKRREEREREER

SEQ ID NO: 2214 - protein, 255 aa, Homo sapiens
MARKKLKKFTTLEIVLSVLLLVLFIISIVLIVLLAKESLKSTAPDPGTTGTPDPGTTGTPDPGTTGTTHARTTGPPDPGTTGTTPVSAECPVVNELERINCIPDQPPTKATCDQRGCCWNPQGAVSVPWCYYSKNHSYHVEGNLVNTNAGFTARLKNLPSSPVFGSNVDNVLLTAEYQTSNRFHFKLTDQTNNRFEVPHEHVQSFSGNAAASLTYQVEISRQPFSIKVTRRSNNRVLFDSSIGPLLFADQFLQLS

SEQ ID NO: 2215 - protein, 255 aa, Homo sapiens
MAESEDRSLRIVLVGKTGSGKSATANTILGEEIFDSRIAAQAVTKNCQKASREWQGRDLLVVDTPGLFDTKESLDTTCKEISRCIISSCPGPHAIVLVLLLGRYTEEEQKTVALIKAVFGKSAMKHMVILFTRKEELEGQSFHDFIADADVGLKSIVKECGNRCCAFSNSKKTSKAEKESQVQELVELIEKMVQCNEGAYFSDDIYKDTEERLKQREEVLRKIYTDQLNEEIKLVEEDKHKSEEEKEKEIKLLKL

SEQ ID NO: 2216 - protein, 178 aa, Homo sapiens
MPRLHDHFWSCSCAHSARRRGPPRASAKLDFANNVQLSLTLAALSLGLWWTFDRSRSGLGLGITIAFLATLITQFLVYNGVYQYTSPDFLYIRSWLPCIFFSGGVTVGNIGRQLAMLIPFCEELNLKTTWLFHKTRSNYRVFLKSPIVIESSKPPILRARKILEENLTVDYDKDYLFS

SEQ ID NO: 2217 - protein, 255 aa, Homo sapiens
MAAALGASGGAGAGDDDFDQFDKPGAERSWRRRAADEDWDSELEDDLLGEDLLSGKKNQSDLSDEELNDDLLQSDNEDEENFSSQGVTISLNATSGMVTSFELSDNTNDQSGEQESEYEQEQGEDELVYHKSDGSELYTQEYPEEGQYEGHEAELTEDQIEYVEEPEEEQLYTDEVLDIEINEPLDEFTGGMETLELQKDIKEESDEEEEDDEESGRLRFKTERKEGTIIRLSDVTRERRNIPETLELSAEAKAA

SEQ ID NO: 2218 - protein, 255 aa, Homo sapiens
MSGHKCSYPWDLQDRYAQDKSVVNKMQQKYWETKQAFIKATGKKEDEHVVASDADLDAKLELFHSIQRTCLDLSKAIVLYQKRICFLSQEENELGKFLRSQGFQDKTRAGKMMQATGKALCFSSQQRLALRNPLCRFHQEVETFRHRAISDTWLTVNRMEQCRTEYRGALLWMKDVSQELDPDLYKQMEKFRKVQTQVRLAKKNFDKLKMDVCQKVDLLGASRCNLLSHMLATYQTTLLHFWEKTSHTMAAIHES

SEQ ID NO: 2219 - protein, 255 aa, Homo sapiens
MFTSEKGVVEEWLSEFKTLPETSLPNYATNLKDKSSLVSSLYKVIQEPQSELLEPVCHQLFEFYRSGEEQLLQFTLQFLPELIWCYLAVSASRNVHSSGCIEALLLGVYNLEIVDKQGHTKVLSFTIPSLSKPSVYHEPSSIGSMALTESALSQHGLSKVVYSGPHPQREMLTAQNRFEVLTFLLLCYNAALTYMPSVSLQSLCQICSRICVCGYPRQHVRKYKGISSRIPVSSGFMVQMLTGIYFAFYNGEWDL

SEQ ID NO: 2220 - protein, 255 aa, Homo sapiens
MAASLRLLGAASGLRYWSRRLRPAAGSFAAVCSRSVASKTPVGFIGLGNMGNPMAKNLMKHGYPLIIYDVFPDACKEFQDAGEQVVSSPADVAEKADRIITMLPTSINAIEAYSGANGILKKVKKGSLLIDSSTIDPAVSKELAKEVEKMGAVFMDAPVSGGVGAARSGNLTFMVGGVEDEFAAAQELLGCMGSNVVYCGAVGTGQAAKICNNMLLAISMIGTAEAMNLGIRLGLDPKLLAKILNMSSGRCWSSD

SEQ ID NO: 2221 - protein, 255 aa, Homo sapiens
MEAARALRLLLVVCGCLALPPLAEPVCPERCDCQHPQHLLCTNRGLRVVPKTSSLPSPHDVLTYSLGGNFITNITAFDFHRLGQLRRLDLQYNQIRSLHPKTFEKLSRLEELYLGNNLLQALAPGTLAPLRKLRILYANGNEISRLSRGSFEGLESLVKLRLDGNALGALPDAVFAPLGNLLYLHLESNRIRFLGKNAFAQLGKLRFLNLSANELQPSLRHAATFAPLRSLSSLILSANNLQHLGPRIFQHLPRL

SEQ ID NO: 2222 - protein, 255 aa, Homo sapiens
MAAAPPSYCFVAFPPRAKDGLVVFGKNSARPRDEVQEVVYFSAADHEPESKVECTYISIDQVPRTYAIMISRPAWLWGAEMGANEHGVCIANEAINTREPAAEIEALLGMDLVRLGLERGETAKEALDVIVSLLEEHGQGGNYFEDANSCHSFQSAYLIVDRDEAWVLETIGKYWAAEKVTEGVRCICSQLSLTTKMDAEHPELRSYAQSQGWWTGEGEFNFSEVFSPVEDHLDCGAGKDSLEKQEESITVQTMM

SEQ ID NO: 2223 - protein, 255 aa, Homo sapiens
MPPPADIVKVAIEWPGAYPKLMEIDQKKPLSAIIKEVCDGWSLANHEYFALQHADSSNFYITEKNRNEIKNGTILRLTTSPAQNAQQLHERIQSSSMDAKLEALKDLASLSRDVTFAQEFINLDGISLLTQMVESGTERYQKLQKIMKPCFGDMLSFTLTAFVELMDHGIVSWDTFSVAFIKKIASFVNKSAIDISILQRSLAILESMVLNSHDLYQKVAQEITIGQLIPHLQGSDQEIQTYTIAVINALFLKAP

SEQ ID NO: 2224 - protein, 255 aa, Homo sapiens
MPLLWLRGFLLASCWIIVRSSPTPGSEGHSAAPDCPSCALAALPKDVPNSQPEMVEAVKKHILNMLHLKKRPDVTQPVPKAALLNAIRKLHVGKVGENGYVEIEDDIGRRAEMNELMEQTSEIITFAESGTARKTLHFEISKEGSDLSVVERAEVWLFLKVPKANRTRTKVTIRLFQQQKHPQGSLDTGEEAEEVGLKGERSELLLSEKVVDARKSTWHVFPVSSSIQRLLDQGKSSLDVRIACEQCQESGASLV

SEQ ID NO: 2225 - protein, 255 aa, Homo sapiens
MATTVTCTRFTDEYQLYEDIGKGAFSVVRRCVKLCTGHEYAAKIINTKKLSARDHQKLEREARICRLLKHSNIVRLHDSISEEGFHYLVFDLVTGGELFEDIVAREYYSEADASHCIQQILEAVLHCHQMGVVHRDLKPENLLLASKCKGAAVKLADFGLAIEVQGDQQAWFGFAGTPGYLSPEVLRKEAYGKPVDIWACGVILYILLVGYPPFWDEDQHKLYQQIKAGAYDFPSPEWDTVTPEAKNLINQMLTI

SEQ ID NO: 2226 - protein, 255 aa, Homo sapiens
MAEAGLRGWLLWALLLRLAQSEPYTTIHQPGYCAFYDECGKNPELSGSLMTLSNVSCLSNTPARKITGDHLILLQKICPRLYTGPNTQACCSAKQLVSLEASLSITKALLTRCPACSDNFVNLHCHNTCSPNQSLFINVTRVAQLGAGQLPAVVAYEAFYQHSFAEQSYDSCSRVRVPAAATLAVGTMCGVYGSALCNAQRWLNFQGDTGNGLAPLDITFHLLEPGQAVGSGIQPLNEGVARCNESQGDDVATCS

SEQ ID NO: 2227 - protein, 255 aa, Homo sapiens
MNASEFRRRGKEMVDYVANYMEGIEGRQVYPDVEPGYLRPLIPAAAPQEPDTFEDIINDVEKIIMPGVTHWHSPYFFAYFPTASSYPAMLADMLCGAIGCIGFSWAASPACTELETVMMDWLGKMLELPKAFLNEKAGEGGGVIQMVATLGTTTCCSFDNLLEVGPICNKEDIWLHVDAAYAGSAFICPEFRHLLNGVEFADSFNFNPHKWLLVNFDCSAMWVKKRTDLTGAFRLDPTYLKHSHQDSGLITDYRH

SEQ ID NO: 2228 - protein, 255 aa, Homo sapiens
MGLYAAAAGVLAGVESRQGSIKGLVYSSNFQNVKQLYALVCETQRYSAVLDAVIASAGLLRAEKKLRPHLAKVLVYELLLGKGFRGGGGRWKALLGRHQARLKAELARLKVHRGVSRNEDLLEVGSRPGPASQLPRFVRVNTLKTCSDDVVDYFKRQGFSYQGRASSLDDLRALKGKHFLLDPLMPELLVFPAQTDLHEHPLYRAGHLILQDRASCLPAMLLDPPPGSHVIDACAAPGNKTSHLAALLKNQGKIF

SEQ ID NO: 2229 - protein, 220 aa, Homo sapiens
MSMGLEITGTALAVLGWLGTIVCCALPMWRVSAFIGSNIITSQNIWEGLWMNCVVQSTGQMQCKVYDSLLALPQDLQAARALIVVAILLAAFGLLVALVGAQCTNCVQDDTAKAKITIVAGVLFLLAALLTLVPVSWSANTIIRDFYNPVVPEAQKREMGAGLYVGWAAAALQLLGGALLCCSCPPREKKYTATKVVYSAPRSTGPGASLGTGYDRKDYV

SEQ ID NO: 2230 - protein, 118 aa, Homo sapiens
MEDFATRTYGTSGLDNRPLFGETSAKDRIINLVVGSLTSLLILVTLISAFVFPQLPPKPLNIFFAVCISLSSITACILIYWYRQGDLEPKFRKLIYYIIFSIIMLCICANLYFHDVGR

SEQ ID NO: 2231 - protein, 198 aa, Homo sapiens
MAYPGHPGAGGGYYPGGYGGAPGGPAFPGQTQDPLYGYFAAVAGQDGQIDADELQRCLTQSGIAGGYKPFNLETCRLMVSMLDRDMSGTMGFNEFKELWAVLNGWRQHFISFDTDRSGTVDPQELQKALTTMGFRLSPQAVNSIAKRYSTNGKITFDDYIACCVKLRALTDSFRRRDTAQQGVVNFPYDDFIQCVMSV

SEQ ID NO: 2232 - protein, 118 aa, Homo sapiens
MRRAGLGEGVPPGNYGNYGYANSGYSACEEENERLTESLRSKVTAIKSLSIEIGHEVKTQNKLLAEMDSQFDSTTGFLGKTMGKLKILSRGSQTKLLCYMMLFSLFVFFIIYWIIKLR

SEQ ID NO: 2233 - protein, 255 aa, Homo sapiens
MALKDYALEKEKVKKFLQEFYQDDELGKKQFKYGNQLVRLAHREQVALYVDLDDVAEDDPELVDSICENARRYAKLFADAVQELLPQYKEREVVNKDVLDVYIEHRLMMEQRSRDPGMVRSPQNQYPAELMRRFELYFQGPSSNKPRVIREVRADSVGKLVTVRGIVTRVSEVKPKMVVATYTCDQCGAETYQPIQSPTFMPLIMCPSQECQTNRSGGRLYLQTRGSRFIKFQEMKMQEHSDQVPVGNIPRSITV

SEQ ID NO: 2234 - protein, 163 aa, Homo sapiens
MSCRGRGAGGRWNSTSWSTGCKLPASPRRVSRCSPTGLIKLAFLFSKTRCKFFSLTETPEDYTIIVDEEGFLELPSSEHLSVADATWLALNVVSGGGSFSSSQPIGMTKIAKSVIAPLADQNISVFMLSTYQTDFILVLKRDLPFVTHTLSSEFTILWSVARL

SEQ ID NO: 2235 - protein, 255 aa, Homo sapiens
MTSERSRIPCLSAAAAEGTGKKQQEGRAMATLDRKVPSPEAFLGKPWSSWIDAAKLHCSDNVDLEEAGKEGGKSREVMRLNKEDMHLFGHYPAHDDFYLVVCSACNQVVKPQVFQSHCERRHGSMCRPSPSPVSPASNPRTSLVQVKTKACLSGHHSASSTSKPFKTPKDNLLTSSSKQHTVFPAKGSRDKPCVPVPVVSLEKIPNLVKADGANVKMNSTTTTAVSASSTSSSAVSTPPLIKPVLMSKSVPPSPE

SEQ ID NO: 2236 - protein, 255 aa, Homo sapiens
MPGARRRRRGAAMEGKPRAGVALAPGPSGRRPSARCARRRRPGLLLPGLWLLLLARPASCAPDELSPEQHNLSLYSMELVLKKSTGHSAAQVALTETAPGSQHSSPLHVTAPPSATTFDTAFFNQGKQTKSTADPSIFVATYVSVTSKEVAVNDDEMDNFLPDTHWTTPRMVSPIQYITVSPPGLPREALEPMLTPSLPMVSLQDEEVTSGWQNTTRQPAAYAESASHFHTFRSAFRTSEGIVPTPGRNLVLYPT

SEQ ID NO: 2237 - protein, 255 aa, Homo sapiens
MAWPNVFQRGSLLSQFSHHHVVVFLLTFFSYSLLHASRKTFSNVKVSISEQWTPSAFNTSVELPVEIWSSNHLFPSAEKATLFLGTLDTIFLFSYAVGLFISGIVGDRLNLRWVLSFGMCSSALVVFVFGALTEWLRFYNKWLYCCLWIVNGLLQSTGWPCVVAVMGNWFGKAGRGVVFGLWSACASVGNILGACLASSVLQYGYEYAFLVTASVQFAGGIVIFFGLLVSPEEIGLSGIEAEENFEEDSHRPLIN

SEQ ID NO: 2238 - protein, 470 aa, Homo sapiens
MTPGLQHPPTVVQRPGMPSGARMPHQGAPMGPPGSPYMGSPAVRPGLAPAGMEPARKRAAPPPGQSQAQSQGQPVPTAPARSRSAKRRKMADKILPQRIRELVPESQAYMDLLAFERKLDQTIMRKRVDIQEALKRPMKQKRKLRLYISNTFNPAKPDAEDSDGSIASWELRVEGKLLDDPSKQKRKFSSFFKSLVIELDKDLYGPDNHLVEWHRTPTTQETDGFQVKRPGDLSVRCTLLLMLDYQPPQFKLDPRLARLLGLHTQSRSAIVQALWQYVKTNRLQDSHDKEYINGDKYFQQIFDCPRLKFSEIPQRLTALLLPPDPIVINHVISVDPSDQKKTACYDIDVEVEEPLKGQMSSFLLSTANQQEISALDSKIHETIESINQLKIQRDFMLSFSRDPKGYVQDLLRSQSRDLKVMTDVAGNPEEERRAEFYHQPWSQEAVSRYFYCKIQQRRQELEQSLVVRNT

SEQ ID NO: 2239 - protein, 255 aa, Homo sapiens
MSSEEDKSVEQPQPPPPPPEEPGAPAPSPAAADKRPRGRPRKDGASPFQRARKKPRSRGKTAVEDEDSMDGLETTETETIVETEIKEQSAEEDAEAEVDNSKQLIPTLQRSVSEESANSLVSVGVEAKISEQLCAFCYCGEKSSLGQGDLKQFRITPGFILPWRNQPSNKKDIDDNSNGTYEKMQNSAPRKQRGQRKERSPQQNIVSCVSVSTQTASDDQAGKLWDELSLVGLPDAIDIQALFDSTGTCWAHHRC

SEQ ID NO: 2240 - protein, 255 aa, Homo sapiens
MNPASDGGTSESIFDLDYASWGIRSTLMVAGFVFYLGVFVVCHQLSSSLNATYRSLVAREKVFWDLAATRAVFGVQSTAAGLWALLGDPVLHADKARGQQNWCWFHITTATGFFCFENVAVHLSNLIFRTFDLFLVIHHLFAFLGFLGCLVNLQAGHYLAMTTLLLEMSTPFTCVSWMLLKAGWSESLFWKLNQWLMIHMFHCRMVLTYHMWWVCFWHWDGLVSSLYLPHLTLFLVGLALLTLIINPYWTHKKTQ

SEQ ID NO: 2241 - protein, 235 aa, Homo sapiens
MLSATRRACQLLLLHSLFPVPRMGNSASNIVSPQEALPGRKEQTPVAAKHHVNGNRTVEPFPEGTQMAVFGMGCFWGAERKFWVLKGVYSTQVGFAGGYTSNPTYKEVCSEKTGHAEVVRVVYQPEHMSFEELLKVFWENHDPTQGMRQGNDHGTQYRSAIYPTSAKQMEAALSSKENYQKVLSEHGFGPITTDIREGQTFYYAEDYHQQYLSKNPNGYCGLGGTGVSCPVGIKK

SEQ ID NO: 2242 - protein, 255 aa, Homo sapiens
MDPFRPSFRGQSPIHPSQCQAVRMPGCWPQASKPLDPALGRGAPAGRGHVFGKPEEPSTQRGPAQRESVGLVSMFRGLGIETVSKTPLKREMLPSGRGILGRGLSANLVRKDREELSPTFWDPKVLAAGDSKMAETSVGWSRTLGRGSSDASLLPLGRAAGGISREVDKPPCTFSTPSRGPPQLSSPPALPQSPLHSPDRPLVLTVEHKEKELIVKQGSKGTPQSLGLNLVKIQCHNEAVYQYHVTFSPNVECKS

SEQ ID NO: 2243 - protein, 255 aa, Homo sapiens
MARHLREYQDLLNVKMALDIEIAAYRKLLEGEETRFSTFAGSITGPLYTHRPPITISSKIQKPKVEAPKLKVQHKFVEEIIEETKVEDEKSEMEEALTAITEELAVSMKEEKKEAAEEKEEEPEAEEEEVAAKKSPVKATAPEVKEEEGEKEEEEGQEEEEEEDEGAKSDQAEEGGSEKEGSSEKEEGEQEEGETEAEAEGEEAEAKEEKKVEEKSEEVATKEELVADAKVEKPEKAKSPVPKSPVEEKGKSPVP

SEQ ID NO: 2244 - protein, 555 aa, Homo sapiens
MTLRAAVFDLDGVLALPAVFGVLGRTEEALALPRGLLNDAFQKGGPEGATTRLMKGEITLSQWIPLMEENCRKCSETAKVCLPKNFSIKEIFDKAISARKINRPMLQAALMLRKKGFTTAILTNTWLDDRAERDGLAQLMCELKMHFDFLIESCQVGMVKPEPQIYKFLLDTLKASPSEVVFLDDIGANLKPARDLGMVTILVQDTDTALKELEKVTGIQLLNTPAPLPTSCNPSDMSHGYVTVKPRVRLHFVELGSGPAVCLCHGFPESWYSWRYQIPALAQAGYRVLAMDMKGYGESSAPPEIEEYCMEVLCKEMVTFLDKLGLSQAVFIGHDWGGMLVWYMALFYPERVRAVASLNTPFIPANPNMSPLESIKANPVFDYQLYFQEPGVAEAELEQNLSRTFKSLFRASDESVLSMHKVCEAGGLFVNSPEEPSLSRMVTEEEIQFYVQQFKKSGFRGPLNWYRNMERNWKWACKSLGRKILIPALMVTAEKDFVLVPQMSQHMEDWIPHLKRGHIEDCGHWTQMDKPTEVNQILIKWLDSDARNPPVVSKM

SEQ ID NO: 2245 - protein, 169 aa, Homo sapiens
MAGIKALISLSFGGAIGLMFLMLGCALPIYNKYWPLFVLFFYILSPIPYCIARRLVDDTDAMSNACKELAIFLTTGIVVSAFGLPIVFARAHLMGRLPFFSKMGTAESEGRETLTQQLPLPAAAMRRLLPASRVSTQPVLRLADSAESLLGRPALWALGFLLCPPSQAQ

SEQ ID NO: 2246 - protein, 255 aa, Homo sapiens
MQSDDVIWDTLGNKQFCSFKIRTKTQSFCRNEYSLTGLCNRSSCPLANSQYATIKEEKGQCYLYMKVIERAAFPRRLWERVRLSKNYEKALEQIDENLIYWPRFIRHKCKQRFTKITQYLIRIRKLTLKRQRKLVPLSKKVERREKRREEKALIAAQLDNAIEKELLERLKQDTYGDIYNFPIHAFDKALEQQEAESDSSDTEEKDDDDDDEEDVGKREFVEDGEVDESDISDFEDMDKLDASSDEDQDGKSSSE

SEQ ID NO: 2247 - protein, 255 aa, Homo sapiens
MIHSLFLINSSGDIFLEKHWKSVVSRSVCDYFFEAQERATEAENVPPVIPTPHHYLLSVYRHKIFFVAVIQTEVPPLFVIEFLHRVVDTFQDYFGVCSEPVIKDNVVVVYEVLEEMLDNGFPLATESNILKELIKPPTILRTVVNTITGSTNVGDQLPTGQLSVVPWRRTGVKYTNNEAYFDVIEEIDAIIDKSGSTITAEIQGVIDACVKLTGMPDLTLSFMNPRLLDDVSFHPCVRFKRWESERILSFIPPDG

SEQ ID NO: 2248 - protein, 376 aa, Homo sapiens
TEGVGEAAQGGEPGQPAQPPPQPHPPPPQQQHKEEMAAEAGEAVASPMDDGFVSLDSPSYVLYRDRAEWADIDPVPQNDGPNPVVQIIYSDKFRDVYDYFRAVLQRDERSERAFKLTRDAIELNAANYTVWHFRRVLLKSLQKDLHEEMNYITAIIEEQPKNYQVWHHRRVLVEWLRDPSQELEFIADILNQDAKNYHAWQHRQWVIQEFKLWDNELQYVDQLLKEDVRNNSVWNQRYFVISNTTGYNDRAVLEREVQYTLEMIKLVPHNESAWNYLKGILQDRGLSKYPNLLNQLLDLQPSHSSPYLIAFLVDIYEDMLENQCDNKEDILNKALELCEILAKEKDTIRKEYWRYIGRSLQSKHSTENDSPTNVQQ

SEQ ID NO: 2249 - protein, 255 aa, Homo sapiens
MEKQPQNSRRGLAPREVPPAVGLLLIMALMNTLLYLCLDHFFIAPRQSTVDPTHCPYGHFRIGQMKNCSPWLSCEELRTEVRQLKRVGEGAVKRVFLSEWKEHKVALSQLTSLEMKDDFLHGLQMLKSLQGTHVVTLLGYCEDDNTMLTEYHPLGSLSNLEETLNLSKYQNVNTWQHRLELAMDYVSIINYLHHSPVGTRVMCDSNDLPKTLSQYLLTSNFSILANDLDALPLVNHSSGMLVKCGHRELHGDFVA

SEQ ID NO: 2250 - protein, 145 aa, Homo sapiens
MAVSTGVKVPRNFRLLEELEEGQKGVGDGTVSWGLEDDEDMTLTRWTGMIIGPPRTNYENRIYSLKVECGPKYPEAPPSVRFVTKINMNGINNSSGMVDARSIPVLAKWQNSYSIKVVLQELRRLMMSKENMKLPQPPEGQTYNN

SEQ ID NO: 2251 - protein, 517 aa, Homo sapiens
MDFRTACEETKTGICLLQDGNQEPFKVRLHLAKDILMIQEQDVICVSGEPFYSGERTVTIRRQTVGGFGLSIKGGAEHNIPVVVSKISKEQRAELSGLLFIGDAILQINGINVRKCRHEEVVQVLRNAGEEVTLTVSFLKRAPAFLKLPLNEDCACAPSDQSSGTSSPLCDSGLHLNYHPNNTDTLSCSSWPTSPGLRWEKRWCDLRLIPLLHSRFSQYVPGTDLSRQNAFQVIAVDGVCTGIIQCLSAEDCVDWLQAIATNISNLTKHNIKKINRNFPVNQQIVYMGWCEAREQDPLQDRVYSPTFLALRGSCLYKFLAPPVTTWDWTRAEKTFSVYEIMCKILKDSDLLDRRKQCFTVQSESGEDLYFSVELESDLAQWERAFQTATFLEVERIQCKTYACVLESHLMGLTIDFSTGFICFDAATKAVLWRYKFSQLKGSSDDGKSKIKFLFQNPDTKQIEAKELEFSNLFAVLHCIHSFFAAKVACLDPLFLGNQATASTAASSATTSKAKYTT

SEQ ID NO: 2252 - protein, 255 aa, Homo sapiens
MSASLNYKSFSKEQQTMDNLEKQLICPICLEMFTKPVVILPCQHNLCRKCASDIFQASNPYLPTRGGTTMASGGRFRCPSCRHEVVLDRHGVYGLQRNLLVENIIDIYKQESTRPEKKSDQPMCEEHEEERINIYCLNCEVPTCSLCKVFGAHKDCQVAPLTHVFQRQKSELSDGIAILVGSNDRVQGVISQLEDTCKTIEECCRKQKQELCEKFDYLYGILEERKNEMTQVITRTQEEKLEHVRALIKKYSDHL

SEQ ID NO: 2253 - protein, 255 aa, Homo sapiens
MSNLKMKEAALIYLDRSGGLQKFIDDCKYYNDSKQSYAVYRFKILINPSDVVELDAELGNHILHQPLKAAEVFQSVCFIAVKTLSLIGQLQTETQINIVLKLTHLPPLPSYGLDLCEFPLDYTSQRFYMMQGIVIAMTTITKYTQGARFLCSDEACPLSKGFQYIRVHVPGATESATIRNDFLCNLCASSLQEDRKFRVLGDKQIVEIIATKALRAFQGYSNNQPFRFQSLTIFLRDESVNKMNIGNEYKIIGIP

SEQ ID NO: 2254 - protein, 255 aa, Homo sapiens
MSEDSRGDSRAESAKDLEKQLRLRVCVLSELQKTERDYVGTLEFLVSAFLHRMNQCAASKVDKNVTEETVKMLFSNIEDILAVHKEFLKVVEECLHPEPNAQQEVGTCFLHFKDKFRIYDEYCSNHEKAQKLLLELNKIRTIRTFLLNCMLLGGRKNTDVPLEGYLVTPIQRICKYPLILKELLKRTPRKHSDYAAVMEALQAMKAVCSNINEAKRQMEKLEVLEEWQSHIEGWEGSNITDTCTEMLMCGVLLKI

SEQ ID NO: 2255 - protein, 249 aa, Homo sapiens
MVDRLANSEANTRRISIVENCFGAAGQPLTIPGRVLIGEGVLTKLCRKKPKARQFFLFNDILVYGNIVIQKKKYNKQHIIPLENVTIDSIKDEGDLRNGWLIKTPTKSFAVYAATATEKSEWMNHINKCVTDLLSKSGKTPSNEHAAVWVPDSEATVCMRCQKAKFTPVNRRHHCRKCGFVVCGPCSEKRFLLPSQSSKPVRICDFCYDLLSAGDMATCQPARSDSYSQSLKSPLNDMSDDDDDDDSSD

SEQ ID NO: 2256 - protein, 145 aa, Homo sapiens
MGCGGSRADAIEPRYYESWTRETESTWLTYTDSDAPPSAAAPDSGPEAGGLHSGMLEDGLPSNGVPRSTAPGGIPNPEKKTNCETQCPNPQSLSSGPLTQKQNGLQTTEAKRDAKRMPAKEVTINVTDSIQQMDRSRRITKNCVN

SEQ ID NO: 2257 - protein, 297 aa, Homo sapiens
MAKVSELYDVTWEEMRDKMRKWREENSRNSEQIVEVGEELINEYASKLGDDIWIIYEQVMIAALDYGRDDLALFCLQELRRQFPGSHRVKRLTGMRFEAMERYDDAIQLYDRILQEDPTNTAARKRKIAIRKAQGKNVEAIRELNEYLEQFVGDQEAWHELAELYINEHDYAKAAFCLEELMMTNPHNHLYCQQYAEVKYTQGGLENLELSRKYFAQALKLNNRNMRALFGLYMSASHIASNPKASAKTKKDNMKYASWAASQINRAYQFAGRSKKETKYSLKAVEDMLETLQITQS

SEQ ID NO: 2258 - protein, 255 aa, Homo sapiens
MDRYLLLVIWGEGKFPSAASREAEHGPEVSSGEGTENQPDFTAANVYHLLKRSISASINPEDSTFPACSVGGIPGSKKWFFAVQAIYGFYQFCSSDWQEIHFDTEKDKIEDVLQTNIEECLGAVECFEEEDSNSRESLSLADLYEEAAENLHQLSDKLPAPGRAMVDIILLLSDKDPPKLKDYLPTVGALKHLREWYSAKITIAGNHCEINCQKIAEYLSANVVSLEDLRNVIDSKELWRGKIQIWERKFGFEIS

SEQ ID NO: 2259 - protein, 255 aa, Homo sapiens
MASKRKSTTPCMVRTSQVVEQDVPEEVDRAKEKGIGTPQPDVAKDSWAAELENSSKENEVIEVKSMGESQSKKLQGGYECKYCPYSTQNLNEFTEHVDMQHPNVILNPLYVCAECNFTTKKYDSLSDHNSKFHPGEANFKLKLIKRNNQTVLEQSIETTNHVVSITTSGPGTGDSDSGISVSKTPIMKPGKPKADAKKVPKKPEEITPENHVEGTARLVTDTAEILSRLGGVELLQDTLGHVMPSVQLPPNINLV

SEQ ID NO: 2260 - protein, 255 aa, Homo sapiens
MAAVGPPQQQVRMAHQQVWAALEVALRVPCLYIIDAIFNSYPDSSQSRFCIVLQIFLRLFGVFASSIVLILSQRSLFKFYTYSSAFLLAATSVLVNYYASLHIDFYGAYNTSAFGIELLPRKGPSLWMALIVLQLTFGIGYVTLLQIHSIYSQLIILDLLVPVIGLITELPLHIRETLLFTSSLILTLNTVFVLAVKLKWFYYSTRYVYLLVRHMYRIYGLQLLMEDTWKRIRFPDILRVFWLTRVTAQATVLMY

SEQ ID NO: 2261 - protein, 255 aa, Homo sapiens
MALVLEIFTLLASICWVSANIFEYQVDAQPLRPCELQRETAFLKQADYVPQCAEDGSFQTVQCQNDGRSCWCVGANGSEVLGSRQPGRPVACLSFCQLQKQQILLSGYINSTDTSYLPQCQDSGDYAPVQCDVQQVQCWCVDAEGMEVYGTRQLGRPKRCPRSCEIRNRRLLHGVGDKSPPQCSAEGEFMPVQCKFVNTTDMMIFDLVHSYNRFPDAFVTFSSFQRRFPEVSGYCHCADSQGRELAETGLELLLD

SEQ ID NO: 2262 - protein, 255 aa, Homo sapiens
MRSLRKKREKPRPEQWKGLPGPPRAPEPEDVAVPGGVDLLTLPQLCFPGGVCVATEPKEDCVHFLVLTDVCGNRTYGVVAQYYRPLHDEYCFYNGKTHRECPGCFVPFAVCVVSRFPYYNSLKDCLSCLLALLKPCKDFEVDSHIKDFAAKLSLIPSPPPGPLHLVFNMKSLQIVLPARADPESPILDLDLHLPLLCFRPEKVLQILTCILTEQRIVFFSSDWALLTLVTECFMAYLYPLQWQHPFVPILSDQML

SEQ ID NO: 2263 - protein, 255 aa, Homo sapiens
MGLWGQSVPTASSARAGRYPGARTASGTRPWLLDPKILKFVVFIVAVLLPVRVDSATIPRQDEVPQQTVAPQQQRRSLKEEECPAGSHRSEYTGACNPCTEGVDYTIASNNLPSCLLCTVCKSGQTNKSSCTTTRDTVCQCEKGSFQDKNSPEMCRTCRTGCPRGMVKVSNCTPRSDIKCKNESAASSTGKTPAAEETVTTILGMLASPYHYLIIIVVLVIILAVVVVGFSCRKKFISYLKGICSGGGGGPERVH

SEQ ID NO: 2264 - protein, 255 aa, Homo sapiens
MERSPDVSPGPSRSFKEELLCAVCYDPFRDAVTLRCGHNFCRGCVSRCWEVQVSPTCPVCKDRASPADLRTNHTLNNLVEKLLREEAEGARWTSYRFSRVCRLHRGQLSLFCLEDKELLCCSCQADPRHQGHRVQPVKDTAHDFRAKCRNMEHALREKAKAFWAMRRSYEAIAKHNQVEAAWLEGRIRQEFDKLREFLRVEEQAILDAMAEETRQKQLLADEKMKQLTEETEVLAHEIERLQMEMKEDDVSFLMK

SEQ ID NO: 2265 - protein, 255 aa, Homo sapiens
MALLPRALSAGAGPSWRRAARAFRGFLLLLPEPAALTRALSRAMACRQEPQPQGPPPAAGAVASYDYLVIGGGSGGLASARRAAELGARAAVVESHKLGGTCVNVGCVPKKVMWNTAVHSEFMHDHADYGFPSCEGKFNWRVIKEKRDAYVSRLNAIYQNNLTKSHIEIIRGHAAFTSDPKPTIEVSGKKYTAPHILIATGGMPSTPHESQIPGASLGITSDGFFQLEELPGRSVIVGAGYIAVEMAGILSALGS

SEQ ID NO: 2266 - protein, 255 aa, Homo sapiens
MDFSFSFMQGIMGNTIQQPPQLIDSANIRQEDAFDNNSDIAEDGGQTPYEATLQQGFQYPATTEDLPPLTNGYPSSISVYETQTKYQSYNQYPNGSANGFGAVRNFSPTDYYHSEIPNTRPHEILEKPSPPQPPPPPSVPQTVIPKKTGSPEIKLKITKTIQNGRELFESSLCGDLLNEVQASEHTKSKHESRKEKRKKSNKHDSSRSEERKSHKIPKLEPEEQNRPNERVDTVSEKPREEPVLKEEAPVQPILS

SEQ ID NO: 2267 - protein, 357 aa, Homo sapiens
MGGAVSAGEDNDDLIDNLKEAQYIRTERVEQAFRAIDRGDYYLEGYRDNAYKDLAWKHGNIHLSAPCIYSEVMEALKLQPGLSFLNLGSGTGYLSTMVGLILGPFGINHGIELHSDVVEYAKEKLESFIKNSDSFDKFEFCEPAFVVGNCLQIASDSHQYDRIYCGAGVQKDHENYMKILLKVGGILVMPIEDQLTQIMRTGQNTWESKNILAVSFAPLVQPSKNDNGKPDSVGLPPCAVRNLQDLARIYIRRTLRNFINDEMQAKGIPQRAPPKRKRKRVKQRINTYVFVGNQLIPQPLDSEEDEKMEEDNKEEEEKDHNEAMKPEEPPQNLLREKIMKLPLPESLKAYLTYFRDK

SEQ ID NO: 2268 - protein, 255 aa, Homo sapiens
MSGMGENTSDPSRAETRKRKECPDQLGPSPKRNTEKRNREQENKYIEELAELIFANFNDIDNFNFKPDKCAILKETVKQIRQIKEQEKAAAANIDEVQKSDVSSTGQGVIDKDALGPMMLEALDGFFFVVNLEGNVVFVSENVTQYLRYNQEELMNKSVYSILHVGDHTEFVKNLLPKSIVNGGSWSGEPPRRNSHTFNCRMLVKPLPDSEEEGHDNQEAHQKYETMQCFAVSQPKSIKEEGEDLQSCLICVARR

SEQ ID NO: 2269 - protein, 255 aa, Homo sapiens
MAIRKKSTKSPPVLSHEFVLQNHADIVSCVAMVFLLGLMFEITAKASIIFVTLQYNVTLPATEEQATESVSLYYYGIKDLATVFFYMLVAIIIHAVIQEYMLDKINRRMHFSKTKHSKFNESGQLSAFYLFACVWGTFILISENYISDPTILWRAYPHNLMTFQMKFFYISQLAYWLHAFPELYFQKTKKEDIPRQLVYIGLYLFHIAGAYLLNLNHLGLVLLVLHYFVEFLFHISRLFYFSNEKYQKGFSLWAV

SEQ ID NO: 2270 - protein, 577 aa, Homo sapiens
MPDRTEKHSTMPDSPVDVKTQSRLTPPTMPPPPTTQGAPRTSSFTPTTLTNGTSHSPTALNGAPSPPNGFSNGPSSSSSSSLANQQLPPACGARQLSKLKRFLTTLQQFGNDISPEIGERVRTLVLGLVNSTLTIEEFHSKLQEATNFPLRPFVIPFLKANLPLLQRELLHCARLAKQNPAQYLAQHEQLLLDASTTSPVDSSELLLDVNENGKRRTPDRTKENGFDREPLHSEHPSKRPCTISPGQRYSPNNGLSYQPNGLPHPTPPPPQHYRLDDMAIAHHYRDSYRHPSHRDLRDRNRPMGLHGTRQEEMIDHRLTDREWAEEWKHLDHLLNCIMDMVEKTRRSLTVLRRCQEADREELNYWIRRYSDAEDLKKGGGSSSSHSRQQSPVNPDPVALDAHREFLHRPASGYVPEEIWKKAEEAVNEVKRQAMTELQKAVSEAERKAHDMITTERAKMERTVAEAKRQAAEDALAVINQQEDSSESCWNCGRKASETCSGCNTARYCGSFCQHKDWEKHHHICGQTLQAQQQGDTPAVSSSVTPNSGAGSPMDTPPAATPRSTTPGTPSTIETTPR

SEQ ID NO: 2271 - protein, 255 aa, Homo sapiens
MQAKKRYFILLSAGSCLALLFYFGGLQFRASRSHSRREEHSGRNGLHHPSPDHFWPRFPDALRPFVPWDQLENEDSSVHISPRQKRDANSSIYKGKKCRMESCFDFTLCKKNGFKVYVYPQQKGEKIAESYQNILAAIEGSRFYTSDPSQACLFVLSLDTLDRDQLSPQYVHNLRSKVQSLHLWNNGRNHLIFNLYSGTWPDYTEDVGFDIGQAMLAKASISTENFRPNFDVSIPLFSKDHPRTGGERGFLKFNT

SEQ ID NO: 2272 - protein, 1129 aa, Homo sapiens
MRSSASRLSSFSSRDSLWNRMPDQISVSEFIAETTEDYNSPTTSSFTTRLHNCRNTVTLLEEALDQDRTALQKVKKSVKAIYNSGQDHVQNEENYAQVLDKFGSNFLSRDNPDLGTAFVKFSTLTKELSTLLKNLLQGLSHNVIFTLDSLLKGDLKGVKGDLKKPFDKAWKDYETKFTKIEKEKREHAKQHGMIRTEITGAEIAEEMEKERRLFQLQMCEYLIKVNEIKTKKGVDLLQNLIKYYHAQCNFFQDGLKTADKLKQYIEKLAADLYNIKQTQDEEKKQLTALRDLIKSSLQLDQKEDSQSRQGGYSMHQLQGNKEYGSEKKGYLLKKSDGIRKVWQRRKCSVKNGILTISHATSNRQPAKLNLLTCQVKPNAEDKKSFDLISHNRTYHFQAEDEQDYVAWISVLTNSKEEALTMAFRGEQSAGENSLEDLTKAIIEDVQRLPGNDICCDCGSSEPTWLSTNLGILTCIECSGIHREMGVHISRIQSLELDKLGTSELLLAKNVGNNSFNDIMEANLPSPSPKPTPSSDMTVRKEYITAKYVDHRFSRKTCSTSSAKLNELLEAIKSRDLLALIQVYAEGVELMEPLLEPGQELGETALHLAVRTADQTSLHLVDFLVQNCGNLDKQTALGNTVLHYCSMYSKPECLKLLLRSKPTVDIVNQAGETALDIAKRLKATQCEDLLSQAKSGKFNPHVHVEYEWNLRQEEIDESDDDLDDKPSPIKKERSPRPQSFCHSSSISPQDKLALPGFSTPRDKQRLSYGAFTNQIFVSTSTDSPTSPTTEAPPLPPRNAGKGPTGPPSTLPLSTQTSSGSSTLSKKRPPPPPPGHKRTLSDPPSPLPHGPPNKGAVPWGNDGGPSSSSKTTNKFEGLSQQSSTSSAKTALGPRVLPKLPQKVALRKTDHLSLDKATIPPEIFQKSSQLAELPQKPPPGDLPPKPTELAPKPQIGDLPPKPGELPPKPQLGDLPPKPQLSDLPPKPQMKDLPPKPQLGDLLAKSQTGDVSPKAQQPSEVTLKSHPLDLSPNVQSRDAIQKQASEDSNDLTPTLPETPVPLPRKINTGKNKVRRVKTIYDCQADNDDELTFIEGEVIIVTGEEDQEWWIGHIEGQPERKGVFPVSFVHILSD

SEQ ID NO: 2273 - protein, 255 aa, Homo sapiens
MEQPWPPPGPWSLPRAEGEAEEESDFDVFPSSPRCPQLPGGGAQMYSHGIELACQKQKEFVKSSVACKWNLAEAQQKLGSLALHNSESLDQEHAKAQTAVSELRQREEEWRQKEEALVQREKMCLWSTDAISKDVFNKSFINQDKRKDTEDEDKSESFMQKYEQKIRHFGMLSRWDDSQRFLSDHPYLVCEETAKYLILWCFHLEAEKKGALMEQIAHQAVVMQFIMEMAKNCNVDPRGCFRLFFQKAKAEEEGY

SEQ ID NO: 2274 - protein, 238 aa, Homo sapiens
MAQQQMTSSQKALMLELKSLQEEPVEGFRITLVDESDLYNWEVAIFGPPNTLYEGGYFKAHIKFPIDYPYSPPTFRFLTKMWHPNIYENGDVCISILHPPVDDPQSGELPSERWNPTQNVRTILLSVISLLNEPNTFSPANVDASVMFRKWRDSKGKDKEYAEIIRKQVSATKAEAEKDGVKVPTTLAEYCIKTKVPSNDNSSDLLYDDLYDDDIDDEDEEEEDADCYDDDDSGNEES

SEQ ID NO: 2275 - protein, 255 aa, Homo sapiens
MASKKLGADFHGTFSYLDDVPFKTGDKFKTPAKVGLPIGFSLPDCLQVVREVQYDFSLEKKTIEWAEEIKKIEEAEREAECKIAEAEAKVNSKSGPEGDSKMSFSKTHSTATMPPPINPILASLQHNSILTPTRVSSSATKQKVLSPPHIKADFNLADFECEEDPFDNLELKTIDEKEELRNILVGTTGPIMAQLLDNNLPRGGSGSVLQDEEVLASLERATLDFKPLHKPNGFITLPQLGNCEKMSLSSKVSLP

SEQ ID NO: 2276 - protein, 51 aa, Homo sapiens
APTGSEAGANWNHWQLHAHYYPPLLRSATVLKFMVGYEMLAQAQRDLTPEQ

SEQ ID NO: 2277 - protein, 139 aa, Homo sapiens
MALRMLWAGQAKGILGGWGIICLVMSLLLQHPGVYSKCYFQAQAPCHYEGKYFTLGESWLRKDCFHCTCLHPVGVGCCDTSQHPIDFPAGCEVRQEAGTCQFSLVQKSDPRLPCKGGGPDPEWGSANTPVPGAPAPHSS

SEQ ID NO: 2278 - protein, 255 aa, Homo sapiens
MEAAVAAPRPRLLLLVLAAAAAAAAALLPGATALQCFCHLCTKDNFTCVTDGLCFVSVTETTDKVIHNSMCIAEIDLIPRDRPFVCAPSSKTGSVTTTYCCNQDHCNKIELPTTGLPLLVQRTIARTIVLQESIGKGRFGEVWRGKWRGEEVAVKIFSSREERSWFREAEIYQTVMLRHENILGFIAADNKDNGTWTQLWLVSDYHEHGSLFDYLNRYTVTVEGMIKLALSTASGLAHLHMEIVGTQGKPAIAHR

SEQ ID NO: 2279 - protein, 181 aa, Homo sapiens
MATEPEAAEPVVPSLVDRYFTRWYKPDVKGKFCEDHCILQHSNRICVITLAESHPVLQSGKTIKSISYQISTNCSRLQNKVSGKFKRGAQFLTELAPLCKIYCSDGEEYTVSSCVRGRLMEVNENILHKPSILQEKPSTEGYIAVVLPKFEESKSITEGLLTQKQYEEVMVKRINATTATS

SEQ ID NO: 2280 - protein, 118 aa, Homo sapiens
MASQSQGIQQLLQAEKRAAEKVSEARKRKNRRLKQAKEEAQAEIEQYRLQREKEFKAKEAAALGSRGSCSTEVEKETQEKMTILQTYFRQNRDEVLDNLLAFVCDIRPEIHENYRING

SEQ ID NO: 2281 - protein, 255 aa, Homo sapiens
MELNFYKIPDNLPFSTKNLDLSFNPLRHLGSYSFFSFPELQVLDLSRCEIQTIEDGAYQSLSHLSTLILTGNPIQSLALGAFSGLSSLQKLVAVETNLASLENFPIGHLKTLKELNVAHNLIQSFKLPEYFSNLTNLEHLDLSSNKIQSIYCTDLRVLHQMPLLNLSLDLSLNPMNFIQPGAFKEIRLHKLTLRNNFDSLNVMKTCIQGLAGLEVHRLVLGEFRNEGNLEKFDKSALEGLCNLTIEEFRLAYLDY

SEQ ID NO: 2282 - protein, 255 aa, Homo sapiens
MAPKRQSPLPPQKKKPRPPPALGPEETSASAGLPKKGEKEQQEAIEHIDEVQNEIDRLNEQASEEILKVEQKYNKLRQPFFQKRSELIAKIPNFWVTTFVNHPQVSALLGEEDEEALHYLTRVEVTEFEDIKSGYRIDFYFDENPYFENKVLSKEFHLNESGDPSSKSTEIKWKSGKDLTKRSSQTQNKASRKRQHEEPESFFTWFTDHSDAGADELGEVIKDDIWPNPLQYYLVPDMDDEEGEGEEDDDDDEEE

SEQ ID NO: 2283 - protein, 137 aa, Homo sapiens [sequence omitted]

SEQ ID NO: 2284 - protein, 392 aa, Homo sapiens
MPLEVVVELQIRAISCPGVFLPGKQDVYLGVYLMNQYLETNSFPSAFPIMIQESMRFEKVFESAVDPGAVVDLLEMWDELAYYEENTRDFLFPEPKLTPSHPRRCREVLMKTALGFPGIAPKIEFSTRTAIRECVFLHRNRFLEERHESRRPLSTSHEPIFPLNTIKMKLRENNLNRLPKGMQARAPSQYSTRHFFQDQPAQLNLGNNFKISGGSKPPFVVRHVDSAKPFGENISEHHLRRSGRKSKFSDFPFPTRRASSLDSLAANVKVIKEPDERIVLRSDSSSCLDSSQFGKSSSSKQGDADFHGKASFATYQHSTSPGPLDQPLLRERFHPGSQSTWKNIHERVCSLLTSHRAQLHQNKEDSTSEVNYIIERPSYPLKKYSLHEQRYF

SEQ ID NO: 2285 - protein, 255 aa, Homo sapiens
MSSASVTAFEKEHLWMYLQALGFEPGPATIACGKIVSHTHLGVNMFDKLNRDAFHIISYFLFQVLDQSLTKEVFKFCWPPFDQKSDTEFRKHCCEWIKRISGECGSSFPQVVGSLFLSPGGPKFIHLMYHFARFVAMKYIKSNSKNSSHHFVETFNIKPQDLHKCIARCHFARSRFLQILQRQDCVTQKYQENAQLSVKQVRNLRSECIGLENQIKKMEPYDDHSNMEEKIQKVRSLWASVNETLMFLEKEREVV

SEQ ID NO: 2286 - protein, 255 aa, Homo sapiens
MKVSLGNGEMGVSAHLQPCKAGTTRFFTSNTHSSVVLQGFDQLRIEGLLCDVTLVPGDGDEIFPVHRAMMASASDYFKAMFTGGMKEQDLMCIKLHGVNKVGLKKIIDFIYTAKLSLNMDNLQDTLEAASFLQILPVLDFCKVFLISGVSLDNCVEVGRIANTYNLIEVDKYVNNFILKNFPALLSTGEFLKLPFERLAFVLSSNSLKHCTELELFKAACRWLRLEDPRMDYAAKLMKNIRFPLMTPQDLINYVQ

SEQ ID NO: 2287 - protein, 216 aa, Homo sapiens
MLQQCFCIIGEKKLQKMLPDVLKNCSIEEIKKLCQEQLELLSEKKILKILEGDNGMDSDMEEEADDGSKMGSDLVSQQDICIDSASSVRENKQPEGLELKQGKGEDSDVLSINADAYDSDIEGPCNEEAAAPEAPENTVQSEAGQIDDLEKDIEKSVNEILGLAESSPNEPKAATLAVPPPEDVQPSAQQLELLELEMRARAIKALMKAGDIKKPA

SEQ ID NO: 2288 - protein, 97 aa, Homo sapiens
MTGYTPDEKLRLQQLRELRRRWLKDQELSPREPVLPPQKMGPMEKFWNKFLENKSPWRKMEKPYGIVEKKSRIFPGDTILETGEVIPPMKEFPDQHH

SEQ ID NO: 2289 - protein, 196 aa, Homo sapiens
MNQADPRLRAVCLWTLTSAAMSRGDNCTDLLALGIPSITQAWGLWVLLGAVTLLFLISLAAHLSQWTRGRSRSHPGQGRSGESVEEVPLYGNLHYLQTGRLSQDPEPDQQDPTLGGPARAAEEVMCYTSLQLRPPQGRIPGPGTPVKYSEVVLDSEPKSQASGPEPELYASVCAQTRRARASFPDQAYANSQPAAS

SEQ ID NO: 2290 - protein, 255 aa, Homo sapiens
MNNLSFSELCCLFCCPPCPGKIASKLAFLPPDPTYTLMCDESGSRWTLHLSERADWQYSSREKDAIECFMTRTSKGNRIACMFVRCSPNAKYTLLFSHGNAVDLGQMSSFYIGLGSRINCNIFSYDYSGYGASSGKPTEKNLYADIEAAWLALRTRYGIRPENVIIYGQSIGTVPSVDLAARYESAAVILHSPLTSGMRVAFPDTKKTYCFDAFPNIDKISKITSPVLIIHGTEDEVIDFSHGLALFERCQRPVE

SEQ ID NO: 2291 - protein, 255 aa, Homo sapiens
MKEQPVLERLQSQKSWIKGVFDKRECSTIIPSSKNPHRCTPVCQVCQNLIRCYCGRLIGDHAGIDYSWTISAAKGKESEQWSVEKHTTKSPTDTFGTINFQDGEHTHHAKYIRTSYDTKLDHLLHLMLKEWKMELPKLVISVHGGIQNFTMPSKFKEIFSQGLVKAAETTGAWIITEGINTGVSKHVGDALKSHSSHSLRKIWTVGIPPWGVIENQRDLIGKDVVCLYQTLDNPLSKLTTLNSMHSHFILSDDGT

SEQ ID NO: 2292 - protein, 255 aa, Homo sapiens
MFASCHCVPRGRRTMKMIHFRSSSVKSLSQEMRCTIRLLDDSEISCHIQRETKGQFLIDHICNYYSLLEKDYFGIRYVDPEKQRHWLEPNKSIFKQMKTHPPYTMCFRVKFYPHEPLKIKEELTRYLLYLQIKRDIFHGRLLCSFSDAAYLGACIVQAELGDYDPDEHPENYISEFEIFPKQSQKLERKIVEIHKNELRGQSPPVAEFNLLLKAHTLETYGVDPHPCKDSTGTTTFLGFTAAGFVVFQGNKRIHL

SEQ ID NO: 2293 - protein, 691 aa, Homo sapiens
MELRSTAAPRAEGYSNVGFQNEENFLENENTSGNNSIRSRAVQSREHTNTKQDEEQVTVEQDSPRNREHMEDDDEEMQQKGCLERRYDTVCGFCRKHKTTLRHIIWGILLAGYLVMVISACVLNFHRALPLFVITVAAIFFVVWDHLMAKYEHRIDEMLSPGRRLLNSHWFWLKWVIWSSLVLAVIFWLAFDTAKLGQQQLVSFGGLIMYIVLLFLFSKYPTRVYWRPVLWGIGLQFLLGLLILRTDPGFIAFDWLGRQVQTFLEYTDAGASFVFGEKYKDHFFAFKVLPIVVFFSTVMSMLYYLGLMQWIIRKVGWIMLVTTGSSPIESVVASGNIFVGQTESPLLVRPYLPYITKSELHAIMTAGFSTIAGSVLGAYISFGVPSSHLLTASVMSAPASLAAAKLFWPETEKPKITLKNAMKMESGDSGNLLEAATQGASSSISLVANIAVNLIAFLALLSFMNSALSWFGNMFDYPQLSFELICSYIFMPFSFMMGVEWQDSFMVARLIGYKTFFNEFVAYEHLSKWIHLRKEGGPKFVNGVQQYISIRSEIIATYALCGFANIGSLGIVIGGLTSMAPSRKRDIASGAVRALIAGTVACFMTACIAGILSSTPVDINCHHVLENAFNSTFPGNTTKVIACCQSLLSSTVAKGPGEVIPGGNHSLYSLKGCCTLLNPSTFNCNGISNTF

SEQ ID NO: 2294 - protein, 255 aa, Homo sapiens
MSAPSEEEEYARLVMEAQPEWLRAEVKRLSHELAETTREKIQAAEYGLAVLEEKHQLKLQFEELEVDYEAIRSEMEQLKEAFGQAHTNHKKVAADGESREESLIQESASKEQYYVRKVLELQTELKQLRNVLTNTQSENERLASVAQELKEINQNVEIQRGRLRDDIKEYKFREARLLQDYSELEEENISLQKQVSVLRQNQVEFEGLKHEIKRLEEETEYLNSQLEDAIRLKEISERQLEEALETLKTEREQKN

SEQ ID NO: 2295 - protein, 255 aa, Homo sapiens
MSETLGDELEILRGKMMQRRPRSAEVKYFYFFKILLRLRLAILKYLFIDDKGILFVSSRKHLPTLPTLLSRLKLFLVKDPLLDFKGQIFTEANFSRECFSLQETLEAFVKEDFCMDKVNFCQEKLEDTICLNEPSSFLIEYEFLIPPSLKPEIDIPSLSELKELLNPVPEIINYVDEKEKLFERDLTNKHGIEDIGDIKFSSTEILTIQSQSEPEECSKPGELEMPLTPLFLTCQHSSVNSLRTELQTFPLSPVC

SEQ ID NO: 2296 - protein, 255 aa, Homo sapiens
MASSETEIRWAEPGLGKGPQRRRWAWAEDKRDVDRSSSQSWEEERLFPNATSPELLEDFRLAQQHLPPLEWDPHPQPDGHQDSESGETSGEEAEAEDVDSPASSHEPLAWLPQQGRQLDMTEEEPDGTLGSLEVEEAGESSSRLGYEAGLSLEGHGNTSPMALGHGQARGWVASGEQASGDKLSEHSEVNPSVELSPARSWSSGTVSLDHPSDSLDSTWEGETDGPQPTALAETLPEGPSHHLLSPDGRTGGSVA

SEQ ID NO: 2297 - protein, 255 aa, Homo sapiens
MNGGAERAMRSLPSLGGLALLCCAAAAAAAAVASAASAGNVTGGGGAAGQVDASPGPGLRGEPSHPFPRATAPTAQAPRTGPPRATVHRPLAATSPAQSPETTPLWATAGPSSTTFQAPLGPSPTTPPAAERTSTTSQAPTRPAPTTLSTTTGPAPTTPVATTVPAPTTPRTPTPDLPSSSNSSVLPTPPATEAPSSPPPEYVCNCSVVGSLNVNRCNQTTGQCECRPGYQGLHCETCKEGFYLNYTSGLCQPCD

SEQ ID NO: 2298 - protein, 255 aa, Homo sapiens
MGLLGILCFLIFLGKTWGQEQTYVISAPKIFRVGASENIVIQVYGYTEAFDATISIKSYPDKKFSYSSGHVHLSSENKFQNSAILTIQPKQLPGGQNPVSYVYLEVVSKHFSKSKRMPITYDNGFLFIHTDKPVYTPDQSVKVRVYSLNDDLKPAKRETVLTFIDPEGSEVDMVEEIDHIGIISFPDFKIPSNPRYGMWTIKAKYKEDFSTTGTAYFEVKEYVLPHFSVSIEPEYNFIGYKNFKNFEITIKARYF

SEQ ID NO: 2299 - protein, 255 aa, Homo sapiens
MFAKLKKKIAEETAVAQRPGGATRIPRSVSKESVASMGADSGDDFASDGSSSREDLSSQLLRRNEQIRKLEARLSDYAEQVRNLQKIKEKLEIALEKHQDSSMRKFQEQNETFQANRAKMAEGLALALARKDQEWSEKMDQLEKEKNILTAQLQEMKNQSMNLFQRRDEMDELEGFQQQELSKIKHMLLKKEESLGKMEQELEARTRELSRTQEELMNSNQMSSDLSQKLEELQRHYSTLEEQRDHVIASKTGAE

SEQ ID NO: 2300 - protein, 255 aa, Homo sapiens
MTEGTKKTSKKFKFFKFKGFGSLSNLPRSFTLRRSSASISRQSHLEPDTFEATQDDMVTVPKSPPAYARSSDMYSHMGTMPRPSIKKAQNSQAARQAQEAGPKPNLVPGGVPDPPGLEAAKEVMVKATGPLEDTPAMEPNPSAVEVDPIRKPEVPTGDVEEERPPRDVHSERAAGEPEAGSDYVKFSKEKYILDSSPEKLHKELEEELKLSSTDLRSHAWYHGRIPREVSETLVQRNGDFLIRDSLTSLGDYVLT

SEQ ID NO: 2301 - protein, 255 aa, Homo sapiens
MAFLMKKKKFKFQTTFTLEELTAVPFVNGVLFCKVRLLDGGDFVSLSSREEVQENCVRWRKRFTFVCKMSANPATGLLDPCVFRVSVRKELKGGKAYSKLGFADLNLAEFAGSGSTVRCCLLEGYDTKNTRQDNSILKVTIGMFLLSGDPCFKTPPSTAKSISIPGQDSSLQLTCKGGGTSSGGSSTNSLTGSRPPKARPTILSSGLPEEPDQNLSSPEEVFHSGHSRNSSYASQQSKISGYSTEHSRSSSLSDL

SEQ ID NO: 2302 - protein, 255 aa, Homo sapiens
MPFLHGFRRIIFEYQPLVDAILGSLGIQDPERQESLDRPSYVASEESRILVLTELLERKAHSPFYQEGVSNALLKMAELGLTRAADVLLRHGANLNFEDPVTYYTALHIAVLRNQPDMVELLVHHGADVNRRDRIHESSPLDLASEEPERLPCLQRLLDLGADVNAADKHGKTALLHALASSDGVQIHNTENIRLLLEGGADVKATTKDGDTVFTCIIFLLGETVGGDKEEAQMINRFCFQVTRLLLAHGADPSE

SEQ ID NO: 2303 - protein, 326 aa, Homo sapiens
MPPMPVASVAPSASMPGSHLPPLYLDGHVFASQPRLVPQTIPQQQSYQQAAAAQQIPISLHTSLQAQAQLGLRGGLPVSQSQEIFSSLQPFRSQVYMHPSLSPPSTMILSGGTALKPPYSAFPGMQPLEMVKPQSGSPYQPMSGNQALVYEGQLSQAAGLGASQMLDSQLPQLTMPLPRYGSGQQPLILPQSIQLPPGQSLSVGAPRRIPPPGSQPPVLNTSREPSQMEMKGFHFADSKQNVPSGGPVPSPQTYRPSSASPSGKPSGSAVNMGSVQGHYVQQAKQRVDEKPSLGAVKLQEAPSAASQMKRTGAIKPRAVKVEESKA

SEQ ID NO: 2304 - protein, 139 aa, Homo sapiens
MAESDWDTVTVLRKKGPTAAQAKSKQAILAAQRRGEDVETSKKWAAGQNKQHSITKNTAKLDRETEELHHDRVTLEVGKVIQQGRQSKGLTQKDLATKINEKPQVIADYESGRAIPNNQVLGKIERAIGECPSTLRRVR

SEQ ID NO: 2305 - protein, 255 aa, Homo sapiens
MDEGGTPLLPDSLVYQIFLSLGPADVLAAGLVCRQWQAVSRDEFLWREQFYRYYQVARDVPRHPAAMSWYEEFQRLYDTVPCVEVQTLREHTDQVLHLSFSHSGYQFASCSKDCTVKIWSNDLTISLLHSADMRPYNWSYTQFSQFNKDDSLLLASGVFLGPHNSSSGEIAVISLDSFALLSRVRNKPYDVFGCWLTETSLISGNLHRIGDITSCSVLWLNNAFQDVESENVNVVKRLFKIQNLNASTVRTVMVA

SEQ ID NO: 2306 - protein, 255 aa, Homo sapiens
MAPPAHKSILERSENVLMSPWKGKLIVQDRMLCDIALWSTYGAMIPTQLPQELDFKYVMKVSSLKKRLPEAAFRKQNYLEEKVCFQDLCFNLYEVELSNRQGENIDKLTECIKNKQLAIIKCLEDRGFFILLTSSALLSEPDFGGKQMGLHGLHLFRSPLSTGVKDLKVEDDISMKVIPILSTLNCALLETKKSLPEERIHPNTLVKRHFQELYKADRSPSLSVAPQDRMKDPTFLGKLPSGFDLIPPAEKCPSE

SEQ ID NO: 2307 - protein, 255 aa, Homo sapiens
MSYEVTSGCHWTCQVPESCDNGLHCAGPLGHLHRRCQRTSAHLLVFTEHAEMRRFKRKHLTAIDCQHLARSHLAVTQPFGQRWTNRDPNHGLYPKPRTKRGSRGQGSQRCIPEFFLAGKQPCTNDMAKSNSVGQDSCQDSEGDMIFPAESSCALPQEGSAGPGSPGSAPPSRKRSWSSEEESNQATGTSRWDGVSKKAPRHHLSVPCTRPREARQEAEDSTSRLSAESGETDQDAGDVGPDPIPDSYYGLLGTLP

SEQ ID NO: 2308 - protein, 255 aa, Homo sapiens
MEVTADQPRWVSHHHPAVLNGQHPDTHHPGLSHSYMDAAQYPLPEEVDVLFNIDGQGNHVPPYYGNSVRATVQRYPPTHHGSQVCRPPLLHGSLPWLDGGKALGSHHTASPWNLSPFSKTSIHHGSPGPLSVYPPASSSSLSGGHASPHLFTFPPTPPKDVSPDPSLSTPGSAGSARQDEKECLKYQVPLPDSMKLESSHSRGSMTALGGASSSTHHPITTYPPYVPEYSSGLFPPSSLLGGSPTGFGCKSRPKA

SEQ ID NO: 2309 - protein, 255 aa, Homo sapiens
MNGALDHSDQPDPDAIKMFVGQIPRSWSEKELKELFEPYGAVYQINVLRDRSQNPPQSKGCCFVTFYTRKAALEAQNALHNIKTLPGMHHPIQMKPADSEKSNAVEDRKLFIGMVSKKCNENDIRVMFSPFGQIEECRILRGPDGLSRGCAFVTFSTRAMAQNAIKAMHQSQTMEGCSSPIVVKFADTQKDKEQRRLQQQLAQQMQQLNTATWGNLTGLGGLTPQYLALLQQATSSSNLGAFSGIQQMAGMNALQ

SEQ ID NO: 2310 - protein, 255 aa, Homo sapiens
MSTRSVSSSSYRRMFGGPGTASRPSSSRSYVTTSTRTYSLGSALRPSTSRSLYASSPGGVYATRSSAVRLRSSVPGVRLLQDSVDFSLADAINTEFKNTRTNEKVELQELNDRFANYIDKVRFLEQQNKILLAELEQLKGQGKSRLGDLYEEEMRELRRQVDQLTNDKARVEVERDNLAEDIMRLREKLQEEMLQREEAENTLQSFRQDVDNASLARLDLERKVESLQEEIAFLKKLHEEEIQELQAQIQEQHVQ

SEQ ID NO: 2311 - protein, 255 aa, Homo sapiens
MPLFATNPFDQDVEKATSEMNTAEDWGLILDICDKVGQSRTGPKDCLRSIMRRVNHKDPHVAMQALTLLGACVSNCGKIFHLEVCSRDFASEVSNVLNKGHPKVCEKLKALMVEWTDEFKNDPQLSLISAMIKNLKEQGVTFPAIGSQAAEQAKASPALVAKDPGTVANKKEEEDLAKAIELSLKEQRQQSTTLSTLYPSTSSLLTNHQHEGRKVRAIYDFEAAEDNELTFKAGEIITVLDDSDPNWWKGETHQG

SEQ ID NO: 2312 - protein, 210 aa, Homo sapiens [sequence omitted]

SEQ ID NO: 2313 - protein, 255 aa, Homo sapiens
MDRHSSYIFIWLQLELCAMAVLLTKGEIRCYCDAAHCVATGYMCKSELSACFSRLLDPQNSNSPLTHGCLDSLASTTDICQAKQARNHSGTTIPTLECCHEDMCNYRGLHDVLSPPRGEASGQGNRYQHDGSRNLITKVQELTSSKELWFRAAVIAVPIAGGLILVLLIMLALRMLRSENKRLQDQRQQMLSRLHYSFHGHHSKKGQVAKLDLECMVPVSGHENCCLTCDKMRQADLSNDKILSLVHWGMYSGHG

SEQ ID NO: 2314 - protein, 448 aa, Homo sapiens [sequence omitted]

SEQ ID NO: 2315 - protein, 255 aa, Homo sapiens
MPSYTVTVATGSQWFAGTDDYIYLSLVGSAGCSEKHLLDKPFYNDFERGAVDSYDVTVDEELGEIQLVRIEKRKYWLNDDWYLKYITLKTPHGDYIEFPCYRWITGDVEVVLRDGRAKLARDDQIHILKQHRRKELETRQKQYRWMEWNPGFPLSIDAKCHKDLPRDIQFDSEKGVDFVLNYSKAMENLFINRFMHMFQSSWNDFADFEKIFVKISNTISERVMNHWQEDLMFGYQFLNGCNPVLIRRCTELPEK

SEQ ID NO: 2316 - protein, 322 aa, Homo sapiens
MYLFSLGSESPKGAIGHIVSTEKTILAVERNKVLLPPLWNRTFSWGFDDFSCCLGSYGSDKVLMTFENLAAWGRCLCAVCPSPTTIVTSGTSTVVCVWELSMTKGRPRGLRLRQALYGHTQAVTCLAASVTFSLLVSGSQDCTCILWDLDHLTHVTRLPAHREGISAITISDVSGTIVSCAGAHLSLWNVNGQPLASITTAWGPEGAITCCCLMEGPAWDTSQIIITGSQDGMVRVWKTEDVKMSVPGRPAGEEPPAQPPSPRGHKWEKNLALSRELDVSIALTGKPSKTSPAVTALAVSRNHTKLLVGDERGRIFCWSADG

SEQ ID NO: 2317 - protein, 158 aa, Homo sapiens
MMQKLLKCSRLVLALALILVLESSVQGYPTRRARYQWVRCNPDSNSANCLEEKGPMFELLPGESNKIPRLRTDLFPKTRIQDLNRIFPLSEDYSGSGFGSGSGSGSGSGSGFLTEMEQDYQLVDESDAFHDNLRSLDRNLPSDSQDLGQHGLEEDFML

SEQ ID NO: 2318 - protein, 255 aa, Homo sapiens
MAAAAGRSLLLLLSSRGGGGGGAGGCGALTAGCFPGLGVSRHRQQQHHRTVHQRIASWQNLGAVYCSTVVPSDDVTVVYQNGLPVISVRLPSRRERCQFTLKPISDSVGVFLRQLQEEDRGIDRVAIYSPDGVRVAASTGIDLLLLDDFKLVINDLTYHVRPPKRDLLSHENAATLNDVKTLVQQLYTTLCIEQHQLNKERELIERLEDLKEQLAPLEKVRIEISRKAEKRTTLVLWGGLAYMATQFGILARLTW

SEQ ID NO: 2319 - protein, 255 aa, Homo sapiens
MISRYTRKAVPQSLELKGITKHALNHHPPPEKLEEISPTSDSHEKDTSSQSKSDITRESSFTSADTGNSLSAFPSYTGAGISTEGSSDFSWGYGELDQNATEKVQTMFTAIDELLYEQKLSVHTKSLQEECQQWTASFPHLRILGRQIITPSEGYRLYPRSPSAVSASYETTLSQERDSTIFGIRGKKLHFSSSYAHKASSIAKSSSFCSMERDEEDSIIVSEGIIEEYLAFDHIDIEEGFHGKKSEAATEKQKL

SEQ ID NO: 2320 - protein, 255 aa, Homo sapiens
MLRAPGCLLRTSVAPAAALAAALLSSLARCSLLEPRDPVASSLSPYFGTKTRYEDVNPVLLSGPEAPWRDPELLEGTCTPVQLVALIRHGTRYPTVKQIRKLRQLHGLLQARGSRDGGASSTGSRDLGAALADWPLWYADWMDGQLVEKGRQDMRQLALRLASLFPALFSRENYGRLRLITSSKHRCMDSSAAFLQGLWQHYHPGLPPPDVADMEFGPPTVNDKLMRFFDHCEKFLTEVEKNATALYHVEAFKTG

SEQ ID NO: 2321 - protein, 255 aa, Homo sapiens
MTAIIKEIVSRNKRRYQEDGFDLDLTYIYPNIIAMGFPAERLEGVYRNNIDDVVRFLDSKHKNHYKIYNLCAERHYDTAKFNCRVAQYPFEDHNPPQLELIKPFCEDLDQWLSEDDNHVAAIHCKAGKGRTGVMICAYLLHRGKFLKAQEALDFYGEVRTRDKKGVTIPSQRRYVYYYSYLLKNHLDYRPVALLFHKMMFETIPMFSGGTCNPQFVVCQLKVKIYSSNSGPTRREDKFMYFEFPQPLPVCGDIKV

SEQ ID NO: 2322 - protein, 255 aa, Homo sapiens
MEDTKESNVKTFCSKNILAILGFSSIIAVIALLAVGLTQNKALPENVKYGIVLDAGSSHTSLYIYKWPAEKENDTGVVHQVEECRVKGPGISKFVQKVNEIGIYLTDCMERAREVIPRSQHQETPVYLGATAGMRLLRMESEELADRVLDVVERSLSNYPFDFQGARIITGQEEGAYGWITINYLLGKFSQKTRWFSIVPYETNNQETFGALDLGGASTQVTFVPQNQTIESPDNALQFRLYGKDYNVYTHSFLC

SEQ ID NO: 2323 - protein, 255 aa, Homo sapiens
MLEKFCNSTFWNSSFLDSPEADLPLCFEQTVLVWIPLGFLWLLAPWQLLHVYKSRTKRSSTTKLYLAKQVFVGFLLILAAIELALVLTEDSGQATVPAVRYTNPSLYLGTWLLVLLIQYSRQWCVQKNSWFLSLFWILSILCGTFQFQTLIRTLLQGDNSNLAYSCLFFISYGFQILILIFSAFSENNESSNNPSSIASFLSSITYSWYDSIILKGYKRPLTLEDVWEVDEEMKTKTLVSKFETHMKRELQKARR

SEQ ID NO: 2324 - protein, 255 aa, Homo sapiens
MEADLSGFNIDAPRWDQRTFLGRVKHFLNITDPRTVFVSERELDWAKVMVEKSRMGVVPPGTQVEQLLYAKKLYDSAFHPDTGEKMNVIGRMSFQLPGGMIITGFMLQFYRTMPAVIFWQWVNQSFNALVNYTNRNAASPTSVRQMALSYFTATTTAVATAVGMNMLTKKAPPLVGRWVPFAAVAAANCVNIPMMRQQELIKGICVKDRNENEIGHSRRAAAIGITQVVISRITMSAPGMILLPVIMERLEKLHF

SEQ ID NO: 2325 - protein, 255 aa, Homo sapiens
MSSSLGKEKDSKEKDPKVPSAKEREKEAKASGGFGKESKEKEPKTKGKDAKDGKKDSSAAQPGVAFSVDNTIKRPNPAPGTRKKSSNAEVIKELNKCREENSMRLDLSKRSIHILPSSIKELTQLTELYLYSNKLQSLPAEVGCLVNLMTLALSENSLTSLPDSLDNLKKLRMLDLRHNKLREIPSVVYRLDSLTTLYLRFNRITTVEKDIKNLSKLSMLSIRENKIKQLPAEIGELCNLITLDVAHNQLEHLPK

SEQ ID NO: 2326 - protein, 255 aa, Homo sapiens
MLFIFNFLFSPLPTPALICILTFGAAIFLWLITRPQPVLPLLDLNNQSVGIEGGARKGVSQKNNDLTSCCFSDAKTMYEVFQRGLAVSDNGPCLGYRKPNQPYRWLSYKQVSDRAEYLGSCLLHKGYKSSPDQFVGIFAQNRPEWIISELACYTYSMVAVPLYDTLGPEAIVHIVNKADIAMVICDTPQKALVLIGNVEKGFTPSLKVIILMDPFDDDLKQRGEKSGIEILSLYDAENLGKEHFRKPVPPSPEDL

SEQ ID NO: 2327 - protein, 255 aa, Homo sapiens
MASRSKRRAVESGVPQPPDPPVQRDEEEEKEVENEDEDDDDSDKEKDEEDEVIDEEVNIEFEAYSLSDNDYDGIKKLLQQLFLKAPVNTAELTDLLIQQNHIGSVIKQTDVSEDSNDDMDEDEVFGFISLLNLTERKGTQCVEQIQELVLRFCEKNCEKSMVEQLDKFLNDTTKPVGLLLSERFINVPPQIALPMYQQLQKELAGAHRTNKPCGKCYFYLLISKTFVEAGKNNSKKKPSNKKKAALMFANAEEEF

SEQ ID NO: 2328 - protein, 255 aa, Homo sapiens
MSELTKELMELVWGTKSSPGLSDTIFCRWTQGFVFSESEGSALEQFEGGPCAVIAPVQAFLLKKLLFSSEKSSWRDCSEEEQKELLCHTLCDILESACCDHSGSYCLVSWLRGKTTEETASISGSPAESSCQVEHSSALAVEELGFERFHALIQKRSFRSLPELKDAVLDQYSMWGNKFGVLLFLYSVLLTKGIENIKNEIEDASEPLIDPVYGHGSQSLINLLLTGHAVSNVWDGDRECSGMKLLGIHEQAAVG

SEQ ID NO: 2329 - protein, 255 aa, Homo sapiens
MMNMSLPFLWSLLTLLIFAEVNGEAGELELQRQKRSINLQQPRMATERGNLVFLTGSAQNIEFRTGSLGKIKLNDEDLSECLHQIQKNKEDIIELKGSAIGLPQNISSQIYQLNSKLVDLERKFQGLQQTVDKKVCSSNPCQNGGTCLNLHDSFFCICPPQWKGPLCSADVNECEIYSGTPLSCQNGGTCVNTMGSYSCHCPPETYGPQCASKYDDCEGGSVARCVHGICEDLMREQAGEPKYSCVCDAGWMFSP

SEQ ID NO: 2330 - protein, 255 aa, Homo sapiens
MKRKERIARRLEGIENDTQPILLQSCTGLVTHRLLEEDTPRYMRASDPASPHIGRSNEEEETSDSSLEKQTRSKYCTETSGVHGDSPYGSGTMDTHSLESKAERIARYKAERRRQLAEKYGLTLDPEADSEYLSRYTKSRKEPDAVEKRGGKSDKQEESSRDASSLYPGTETMGLRTCAGESKDYALHVGDGSSDPEVLLNIENQRRGQELSATRQAHDLSPAAESSSTFSFSGRDSSFTEVPRSPKHAHSSSLQ

SEQ ID NO: 2331 - protein, 255 aa, Homo sapiens
MGNFKSRKPKSIFKAESGRSHGESQETEHVVSSQSECQVRAGTPAHESPQNNAFKCQETVRLQPRIDQRTAISPKDAFETRQDLNEEEAAQVHGVKDPAPASTQSVLADGTDSADPSPVHKDGQNEADSAPEDLHSVGTSRLLYHITDGDNPLLSPRCSIFSQSQRFNLDPESAPSPPSTQQFMMPRSSSRCSCGDGKEPQTITQLTKHIQSLKRKIRKFEEKFEQEKKYRPSHGDKTSNPEVLKWMNDLAKGRK

SEQ ID NO: 2332 - protein, 255 aa, Homo sapiens
MVHAEAFSRPLSRNEVVGLIFRLTIFGAVTYFTIKWMVDAIDPTRKQKVEAQKQAEKLMKQIGVKNVKLSEYEMSIAAHLVDPLNMHVTWSDIAGLDDVITDLKDTVILPIKKKHLFENSRLLQPPKGVLLYGPPGCGKTLIAKATAKEAGCRFINLQPSTLTDKWYGESQKLAAAVFSLAIKLQPSIIFIDEIDSFLRNRSSSDHEATAMMKAQFMSLWDGLDTDHSCQVIVMGATNRPQDLDSAIMRRMPTRF

SEQ ID NO: 2333 - protein, 191 aa, Homo sapiens
MGILYSEPICQAAYQNDFGQVWRWVKEDSSYANVQDGFNGDTPLICACRRGHVRIVSFLLRRNANVNLKNQKERTCLHYAVKKKFTFIDYLLIILLMPVLLIGYFLMVSKTKQNEALVRMLLDAGVEVNATDCYGCTALHYACEMKNQSLIPLLLEARADPTIKNKHGESSLDIARRLKFSQIELMLRKAL

SEQ ID NO: 2334 - protein, 255 aa, Homo sapiens
MQRLLFPPLRALKGRQYLPLLAPRAAPRAQCDCIRRPLRPGQYSTISEVALQSGRGTVSLPSKAAERVVGRWLLVCSGTVAGAVILGGVTRLTESGLSMVDWHLIKEMKPPTSQEEWEAEFQRYQQFPEFKILNHDMTLTEFKFIWYMEYSHRMWGRLVGLVYILPAAYFWRKGWLSRGMKGRVLALCGLVCFQGLLGWYMVKSGLEEKSDSHDIPRVSQYRLAAHLGSALVLYCASLWTSLSLLLPPHKLPETH

SEQ ID NO: 2335 - protein, 255 aa, Homo sapiens
MNMTQARVLVAAVVGLVAVLLYASIHKIEEGHLAVYYRGGALLTSPSGPGYHIMLPFITTFRSVQTTLQTDEVKNVPCGTSGGVMIYIDRIEVVNMLAPYAVFDIVRNYTADYDKTLIFNKIHHELNQFCSAHTLQEVYIELFDQIDENLKQALQKDLNLMAPGLTIQAVRVTKPKIPEAIRRNFELMEAEKTKLLIAAQKQKVVEKEAETERKKAVIEAEKIAQVAKIRFQQKVMEKETEKRISEIEDAAFLAR

SEQ ID NO: 2336 - protein, 255 aa, Homo sapiens
MESYDVIANQPVVIDNGSGVIKAGFAGDQIPKYCFPNYVGRPKHVRVMAGALEGDIFIGPKAEEHRGLLSIRYPMEHGIVKDWNDMERIWQYVYSKDQLQTFSEEHPVLLTEAPLNPRKNRERAAEVFFETFNVPALFISMQAVLSLYATGRTTGVVLDSGDGVTHAVPIYEGFAMPHSIMRIDIAGRDVSRFLRLYLRKEGYDFHSSSEFEIVKAIKERACYLSINPQKDETLETEKAQYYLPDGSTIEIGPSR

SEQ ID NO: 2337 - protein, 255 aa, Homo sapiens
MPAFLGLKCLGKLCSSEKSKVTSSERTSARGSNRKRLIVEDRRVSGTSFTAHRRATITHLLYLCPKDYCPRGRVCNSVDPFVAHPQDPHHPSEKPVIHCHKCGEPCKGEVLRVQTKHFHIKCFTCKVCGCDLAQGGFFIKNGEYLCTLDYQRMYGTRCHGCGEFVEGEVVTALGKTYHPNCFACTICKRPFPPGDRVTFNGRDCLCQLCAQPMSSSPKETTFSSNCAGCGRDIKNGQALLALDKQWHLGCFKCKS

SEQ ID NO: 2338 - protein, 255 aa, Homo sapiens
MMLSEQAQKWFPTHVQVTVLQAKDLKPKGKSGTNDTYTIIQLGKEKYSTSVAEKTLEPVWKEEASFELPGLLIQGSPEKYILFLIVMHRSLVGLDKFLGQVAINLNDIFEDKQRRKTEWFRLESKQGKRIKNRGEIKVNIQFMRNNMTASMFDLSMKDKTRSPFAKLKDKMKGRKNDGTFSDTSSAIIPSTHMPDANSEFSSGEIQMKSKPKKPFLLGPQRLSSAHSMSDLSGSHMSSEKLKAGTIGQTHLLGHQ

SEQ ID NO: 2339 - protein, 233 aa, Homo sapiens
MWSGLLPPGLNESDAESNSEDEATLENSGLNLQEDKEDESIRKTEIIDFSTDEPKTETESNVNAYEECPSGIPIDMWNKFQELHKKHSEQKSTTSRFRGKRRKRSRKDKLKNEKELHSEPSSNETQWKELTQYFGVNDRFDPPVKRKKVEKSGLEKRIDQAVEEWNIEKAEELSNQLATRELGVKIAKAVACHNFVKAKKEVENSQAARKKKKLAWGFEAKKRWETKSNMGYM

SEQ ID NO: 2340 - protein, 255 aa, Homo sapiens
MAAAVGRLLRASVARHVSAIPWGISATAALRPAACGRTSLTNLLCSGSSQAKLFSTSSSCHAPAVTQHAPYFKGTAVVNGEFKDLSLDDFKGKYLVLFFYPLDFTFVCPTEIVAFSDKANEFHDVNCEVVAVSVDSHFSHLAWINTPRKNGGLGHMNIALLSDLTKQISRDYGVLLEGSGLALRGLFIIDPNGVIKHLSVNDLPVGRSVEETLRLVKAFQYVETHGEVCPANWTPDSPTIKPSPAASKEYFQKVN

SEQ ID NO: 2341 - protein, 255 aa, Homo sapiens
MPCGEDWLSHPLGIVQGFFAQNGVNPDWEKKVIEYFKEKLKENNAPKWVPSLNEVPLHYLKPNSFVKFRCMIQDMFDPEFYMGVYETVNQNTKAHVLHFGKYRDVAECGPQQELDLNSPRNTTLERQTFYCVPVPGESTWVKEAYVNANQARVSPSTSYTPSRHKRSYEDDDDMDLQPNKQKDQHAGARQAGSVGGLQWCGEPKRLETEASTGQQLNSLNLSSPFDLNFPLPGEKGPACLVKVYEDWDCFKVNDI

SEQ ID NO: 2342 - protein, 255 aa, Homo sapiens
MSGDSSGRGPEGRGRGRDPHRDRTRSRSRSRSPLSPRSRRGSARERREAPERPSLEDTEPSDSGDEMMDPASLEAEADQGLCRQIRHQYRALINSVQQNREDILNAGDKLTEVLEEANTLFNEVSRAREAVLDAHFLVLASDLGKEKAKQLRSDLSSFDMLRYVETLLTHMGVNPLEAEELIRDEDSPDFEFIVYDSWKITGRTAENTFNKTHTFHFLLGSIYGECPVPKPRVDRPRKVPVIQEERAMPAQLRRM

SEQ ID NO: 2343 - protein, 255 aa, Homo sapiens
MSSSPVKRQRMESALDQLKQFTTVVADTGDFHAIDEYKPQDATTNPSLILAAAQMPAYQELVEEAIAYGRKLGGSQEDQIKNAIDKLFVLFGAEILKKIPGRVSTEVDARLSFDKDAMVARARRLIELYKEAGISKDRILIKLSSTWEGIQAGKELEEQHGIHCNMTLLFSFAQAVACAEAGVTLISPFVGRILDWHVANTDKKSYEPLEDPGVKSVTKIYNYYKKFSYKTIVMGASFRNTGEIKALAGCDFLTI

SEQ ID NO: 2344 - protein, 256 aa, Homo sapiens
MSDEEVEQVEEQYEEEEEAQEEAAEVHEEVHEPEEKPRPKLTAPKIPEGEKVDFDDIQKKRQNKDLMELQALIDSHFEARKKEEEELVALKERIEKRRAERAEQQRIRAEKERERQNRLAEEKARREEEDAKRRAEDDLKKKKALSSMGANYSSYLAKADQKRGKKQTAREMKKKILAERRKPLNIDHLGEDKLRDKAKELWETLHQLEIDKFEFGEKLKRQKYDITTLRSRIDQAQKHSKKAGTPAKGKVGGRWK

SEQ ID NO: 2345 - protein, 103 aa, Homo sapiens
MERQQQQQQQLRNLRDFLLVYNRMTELCFQRCVPSLHHRALDAEEEACLHSCAGKLIHSNHRLMAAYVQLMPALVQRRIADYEAASAVPGVAAEQPGVSPSGS

SEQ ID NO: 2346 - protein, 255 aa, Homo sapiens
MRRDERDAKAMRSLQPPDGAGSPPESLRNGYVKSCVSPLRQDPPRGFFFHLCRFCNVELRPPPASPQQPRRCSPFCRARLSLGALAAFVLALLLGAEPESWAAGAAWLRTLLSVCSHSLSPLFSIACAFFFLTCFLTRTKRGPGPGRSCGSWWLLALPACCYLGDFLVWQWWSWPWGDGDAGSAAPHTPPEAAAGRLLLVLSCVGLLLTLAHPLRLRHCVLVLLLASFVWWVSFTSLGSLPSALRPLLSGLVGGA

SEQ ID NO: 2347 - protein, 149 aa, Homo sapiens
MMAVEQMPKKDWYSILGADPSANISDLKQKYQKLILMYHPDKQSTDVPAGTVEECVQKFIEIDQAWKILGNEETKREYDLQRCEDDLRNVGPVDAQVYLEEMSWNEGDHSFYLSCRCGGKYSVSKDEAEEVSLISCDTCSLIIELLHYN

SEQ ID NO: 2348 - protein, 255 aa, Homo sapiens
MKPAAREARLPPRSPGLRWALPLLLLLLRLGQILCAGGTPSPIPDPSVATVATGENGITQISSTAESFHKQNGTGTPQVETNTSEDGESSGANDSLRTPEQGSNGTDGASQKTPSSTGPSPVFDIKAVSISPTNVILTWKSNDTAASEYKYVVKHKMENEKTITVVHQPWCNITGLRPATSYVFSITPGIGNETWGDPRVIKVITEPIPVSDLRVALTGVRKAALSWSNGNGTASCRVLLESIGSHEELTQDSRL

SEQ ID NO: 2349 - protein, 121 aa, Homo sapiens
MAPRGRKRKAEAAVVAVAEKREKLANGGEGMEEATVVIEHCTSRVYGRNAAALSQALRLEAPELPVKVNPTKPRRGSFEVTLLRPDGSSAELWTGIKKGPPRKLKFPEPQEVVEELKKYLS

SEQ ID NO: 2350 - protein, 243 aa, Homo sapiens
MAASSISSPWGKHVFKAILMVLVALILLHSALAQSRRDFAPPGQQKREAPVDVLTQIGRSVRGTLDAWIGPETMHLVSESSSQVLWAISSAISVAFFALSGIAAQLLNALGLAGDYLAQGLKLSPGQVQTFLLWGAGALVVYWLLSLLLGLVLALLGRILWGLKLVIFLAGFVALMRSVPDPSTRALLLLALLILYALLSRLTGSRASGAQLEAKVRGLERQVEELRWRQRRAAKGARSVEEE

SEQ ID NO: 2351 - protein, 255 aa, Homo sapiens
MWLFFGITGLLTAALSGHPSPAPPDQLNTSSAESELWEPGERLPVRLTNGSSSCSGTVEVRLEASWEPACGALWDSRAAEAVCRALGCGGAEAASQLAPPTPELPPPPAAGNTSVAANATLAGAPALLCSGAEWRLCEVVEHACRSDGRRARVTCAENRALRLVDGGGACAGRVEMLEHGEWGSVCDDTWDLEDAHVVCRQLGCGWAVQALPGLHFTPGRGPIHRDQVNCSGAEAYLWDCPGLPGQHYCGHKEDA

SEQ ID NO: 2352 - protein, 255 aa, Homo sapiens
MPMGSLQPLATLYLLGMLVASCLGRLSWYDPDFQARLTRSNSKCQGQLEVYLKDGWHMVCSQSWGRSSKQWEDPSQASKVCQRLNCGVPLSLGPFLVTYTPQSSIICYGQLGSFSNCSHSRNDMCHSLGLTCLEPQKTTPPTTRPPPTTTPEPTAPPRLQLVAQSGGQHCAGVVEFYSGSLGGTISYEAQDKTQDLENFLCNNLQCGSFLKHLPETEAGRAQDPGEPREHQPLPIQWKIQNSSCTSLEHCFRKIK

SEQ ID NO: 2353 - protein, 162 aa, Homo sapiens
MLQTSNYSLVLSLQFLLLSYDLFVNSFSELLQKTPVIQLVLFIIQDIAVLFNIIIIFLMFFNTFVFQAGLVNLLFHKFKGTIILTAVYFALSISLHVWVMNLRWKNSNSFIWTDGLQMLFVFQRLAAVLYCYFYKRTAVRLGDPHFYQDSLWLRKEFMQVRR

SEQ ID NO: 2354 - protein, 172 aa, Homo sapiens
MFYHISLEHEILLHPRYFGPNLLNTVKQKLFTEVEGTCTGKYGFVIAVTTIDNIGAGVIQPGRGFVLYPVKYKAIVFRPFKGEVVDAVVTQVNKVGLFTEIGPMSCFISRHSIPSEMEFDPNSNPPCYKTMDEDIVIQQDDEIRLKIVGTRVDKNDIFAIGSLMDDYLGLVS

SEQ ID NO: 2355 - protein, 219 aa, Homo sapiens
MALSWLQRVELALFAAAFLCGAVAAAAMTRTQGSFSGRCPLYGVATLNGSSLALSRPSAPSLCYFVAGASGLLALYCLLLLLFWIYSSCIEDSHRGAIGLRIALAISAIAVFLVLVSACILRFGTRSLCNSIISLNTTISCSEAQKIPWTPPGTALQFYSNLHNAETSSWVNLVLWCVVLVLQVVQWKSEATPYRPLERGDPEWSSETDALVGSRLSHS

SEQ ID NO: 2356 - protein, 237 aa, Homo sapiens
MGRKSSKAKEKKQKRLEERAAMDAVCAKVDAANRLGDPLEAFPVFKKYDRNGLNVSIECKRVSGLEPATVDWAFDLTKTNMQTMYEQSEWGWKDREKREEMTDDRAWYLIAWENSSVPVAFSHFRFDVECGDEVLYCYEVQLESKVRRKGLGKFLIQILQLMANSTQMKKVMLTVFKHNHGAYQFFREALQFEIDDSSPSMSGCCGEDCSYEILSRRTKFGDSHHSHAGGHCGGCCH

SEQ ID NO: 2357 - protein, 255 aa, Homo sapiens
MAAEEPQQQKQEPLGSDSEGVNCLAYDEAIMAQQDRIQQEIAVQNPLVSERLELSVLYKEYAEDDNIYQQKIKDLHKKYSYIRKTRPDGNCFYRAFGFSHLEALLDDSKELQRFKAVSAKSKEDLVSQGFTEFTIEDFHNTFMDLIEQVEKQTSVADLLASFNDQSTSDYLVVYLRLLTSGYLQRESKFFEHFIEGGRTVKEFCQQEVEPMCKESDHIHIIALAQALSVSIQVEYMDRGEGGTTNPHIFPEGSEP

SEQ ID NO: 2358 - protein, 75 aa, Homo sapiens
MGELTDALLGKGALKTRFGSLLGQGDWGGVRVSQVEVRWVIFCLLHWLHVNLPVTEYLALDVLFPLAIVQKHSIL

SEQ ID NO: 2359 - protein, 255 aa, Homo sapiens
MADIIARLREDGIQKRVIQEGRGELPDFQDGTKATFHYRTLHSDDEGTVLDDSRARGKPMELIIGKKFKLPVWETIVCTMREGEIAQFLCDIKHVVLYPLVAKSLRNIAVGKDPLEGQRHCCGVAQMREHSSLGHADLDALQQNPQPLIFHMEMLKVESPGTYQQDPWAMTDEEKAKAVPLIHQEGNRLYREGHVKEAAAKYYDAIACLKNLQMKEQPGSPEWIQLDQQITPLLLNYCQCKLVVEEYYEVLDHCS

SEQ ID NO: 2360 - protein, 255 aa, Homo sapiens
MMCEVMPTISEAEGPPGGGGGHGSGSPSQPDADSHFEQLMVSMLEERDRLLDTLRETQETLALTQGKLHEVGHERDSLQRQLNTALPQEFAALTKELNVCREQLLEREEEIAELKAERNNTRLLLEHLECLVSRHERSLRMTVVKRQAQSPAGVSSEVEVLKALKSLFEHHKALDEKVRERLRVALERCSLLEEELGATHKELMILKEQNNQKKTLTDGVLDINHEQENTPSTSGKRSSDGSLSHEEDLAKVIEL

SEQ ID NO: 2361 - protein, 194 aa, Homo sapiens
MTMRHNWTPDLSPLWVLLLCAHVVTLLVRATPVSQTTTAATASVRSTKDPCPSQPPVFPAAKQCPALEVTWPEVEVPLNGTLSLSCVACSRFPNFSILYWLGNGSFIEHLPGRLWEGSTSRERGSTGTQLCKALVLEQLTPALHSTNFSCVLVDPEQVVQRHVVLAQLWAGLRATLPPTQEALPSSHSSPQQQG

SEQ ID NO: 2362 - protein, 255 aa, Homo sapiens
MPVVWPTLLDLSRDECKRILRKLELEAYAGVISALRAQGDLTKEKKDLLGELSKVLSISTERHRAEVRRAVNDERLTTIAHNMSGPNSSSEWSIEGRRLVPLMPRLVPQTAFTVTANAVANAAIQHNASLPVPAETGSKEVVCYSYTSTTSTPTSTPVPSGSIATVKSPRPASPASNVVVLPSGSTVYVKSVSCSDEDEKPRKRRRTNSSSSSPVVLKEVPKAVVPVSKTITVPVSGSPKMSNIMQSIANSLPPH

SEQ ID NO: 2363 - protein, 255 aa, Homo sapiens
MNRRRKFLLASVLALQNSSFIYPSCQKCFSRIILVSKRSNCPKCGSTGESGNANYRYKLSLKVAESNKLFVITVFGSCLDTFFGLTATGLHRYIQDPNKIPETLDNDTTQNLLTKAVETCFVGQSFIFGVTNFENQPGQGSDASNFLQQCSDHKRKAKALVACQIVLPDPGIAGFTVIDYFHQLLQTFNFRKLQCDSQAPNNHLLALDHSNSDLSSIYTSDSTSDFFKSCSKDTFSKFWQPSLEFTCIVSQLTDN

SEQ ID NO: 2364 - protein, 110 aa, Homo sapiens
MAASMHGQPSPSLEDAKLRRPMVIEIIEKNFDYLRKEMTQNIYQMATFGTTAGFSGIFSNFLFRRCFKVKHDALKTYASLATLPFLSTVVTDKLFVIDALYSGEFKFTNV

SEQ ID NO: 2365 - protein, 197 aa, Homo sapiens
MFGCLVAGRLVQTAAQQVAEDKFVFDLPDYESINHVVVFMLGTIPFPEGMGGSVYFSYPDSNGMPVWQLLGFVTNGKPSAIFKISGLKSGEGSQHPFGAMNIVRTPSVAQIGISVELLDSMAQQTPVGNAAVSSVDSFTQFTQKMLDNFYNFASSFAVSQAQMTPSPSEMFIPANVVLKWYENFQRRLAQNPLFWKT

SEQ ID NO: 2366 - protein, 255 aa, Homo sapiens
MSGRARVKARGIARSPSATEVGRIQASPLPRSVDLSNNEASSSNGFLGTSRISTNDKYGISSGDAGSTFMERGVKNKQDFMDLSICTREKLAHVRNCKTGSSGIPVKLVTNLFNLDFPQDWQLYQYHVTYIPDLASRRLRIALLYSHSELSNKAKAFDGAILFLSQKLEEKVTELSSETQRGETIKMTITLKRELPSSSPVCIQVFNIIFRKILKKLSMYQIGRNFYNPSEPMEIPQHKLSLWPGFAISVSYFER

SEQ ID NO: 2367 - protein, 145 aa, Homo sapiens
MSTEGGGRRCQAQVSRRISFSASHRLYSKFLSDEENLKLFGKCNNPNGHGHNYKVVVTVHGEIDPATGMVMNLADLKKYMEEAIMQPLDHKNLDMDVPYFADVVSTTENVAVYIWDNLQKVLPVGVLYKVKVYETDNNIVVYKGE

SEQ ID NO: 2368 - protein, 229 aa, Homo sapiens
MSQGDSNPAAIPHAAEDIQGDDRWMSQHNRFVLDCKDKEPDVLFVGDSMVQLMQQYEIWRELFSPLHALNFGIGGDTTRHVLWRLKNGELENIKPKVIVVWVGTNNHENTAEEVAGGIEAIVQLINTRQPQAKIIVLGLLPRGEKPNPLRQKNAKVNQLLKVSLPKLANVQLLDTDGGFVHSDGAISCHDMFDFLHLTGGGYAKICKPLHELIMQLLEETPEEKQTTIA

SEQ ID NO: 2369 - protein, 255 aa, Homo sapiens
MTDQENNNNISSNPFAALFGSLADAKQFAAIQKEQLKQQSDELPASPDDSDNSVSESLDEFDYSVAEISRSFRSQQEICEQLNINHMIQRIFLITLDNSDPSLKSGNGIPSRCVYLEEMAVELEDQDWLDMSNVEQALFARLLLQDPGNHLINMTSSTTLNLSADRDAGERHIFCYLYSCFQRAKEEITKVPENLLPFAVQCRNLTVSNTRTVLLTPEIYVDQNIHEQLVDLMLEAIQGAREYMNKIYFEDVTEF

SEQ ID NO: 2370 - protein, 219 aa, Homo sapiens
MAIFSVYVVNKAGGLIYQLDSYAPRAEAEKTFSYPLDLLLKLHDERVLVAFGQRDGIRVGHAVLAINGMDVNGRYTADGKEVLEYLGNPANYPVSIRFGRPRLTSNEKLMLASMFHSLFAIGSQLSPEQGSSGIEMLETDTFKLHCYQTLTGIKFVVLADPRQAGIDSLLRKIYEIYSDFALKNPFYSLEMPIRCELFDQNLKLALEVAEKAGTFGPGS

SEQ ID NO: 2371 - protein, 255 aa, Homo sapiens
MDLVLRVADYYFFTPYVYPATWPEDDIFRQAISLLIVTNVGAYILYFFCATLSYYFVFDHALMKHPQFLKNQVRREIKFTVQALPWISILTVALFLLEIRGYSKLHDDLGEFPYGLFELVVSIISFLFFTDMFIYWIHRGLHHRLVYKRLHKPHHIWKIPTPFASHAFHPIDGFLQSLPYHIYPFIFPLHKVVYLSLYILVNIWTISIHDGDFRVPQILQPFINGSAHHTDHHMFFDYNYGQYFTLWDRIGGSFK

SEQ ID NO: 2372 - protein, 255 aa, Homo sapiens
MVHFCGLLTLHREPVPLKSISVSVNIYEFVAGVSATLNYENEEKVPLEAFFVFPMDEDSAVYSFEALVDGKKIVAELQDKMKARTNYEKAISQGHQAFLLEGDSSSRDVFSCNVGNLQPGSKAAVTLKYVQELPLEADGALRFVLPAVLNPRYQFSGSSKDSCLNVKTPIVPVEDLPYTLSMVATIDSQHGIEKVQSNCPLSPTEYLGEDKTSAQVSLAAGHKFDRDVELLIYYNEVHTPSVVLEMGMPNMKPGH

SEQ ID NO: 2373 - protein, 255 aa, Homo sapiens
MTKFGFLRLSYEKQDTLLKLLILSMAAVLSFSTRLFAVLRFESVIHEFDPYFNYRTTRFLAEEGFYKFHNWFDDRAWYPLGRIIGGTIYPGLMITSAAIYHVLHFFHITIDIRNVCVFLAPLFSSFTTIVTYHLTKELKDAGAGLLAAAMIAVVPGYISRSVAGSYDNEGIAIFCMLLTYYMWIKAVKTGSICWAAKCALAYFYMVSSWGGYVFLINLIPLHVLVLMLTGRFSHRIYVAYCTVYCLGTILSMQIS

SEQ ID NO: 2374 - protein, 255 aa, Homo sapiens
MSFFGFGQSVEVEILLNDAESRKRAEHKTEDGKKEKYFLFYDGETVSGKVSLALKNPNKRLEHQGIKIEFIGQIELYYDRGNHHEFVSLVKDLARPGEITQSQAFDFEFTHVEKPYESYTGQNVKLRYFLRATISRRLNDVVKEMDIVVHTLSTYPELNSSIKMEVGIEDCLHIEFEYNKSKYHLKDVIVGKIYFLLVRIKIKHMEIDIIKRETTGTGPNVYHENDTIAKYEIMDGAPVRGESIPIRLFLAGYEL

SEQ ID NO: 2375 - protein, 255 aa, Homo sapiens
MASAARLTMMWEEVTCPICLDPFVEPVSIECGHSFCQECISQVGKGGGSVCPVCRQRFLLKNLRPNRQLANMVNNLKEISQEAREGTQGERCAVHGERLHLFCEKDGKALCWVCAQSRKHRDHAMVPLEEAAQEYQEKLQVALGELRRKQELAEKLEVEIAIKRADWKKTVETQKSRIHAEFVQQKNFLVEEEQRQLQELEKDEREQLRILGEKEAKLAQQSQALQELISELDRRCHSSALELLQEVIIVLERSE

SEQ ID NO: 2376 - protein, 255 aa, Homo sapiens
MIAPLLCILSYNFNTFAILNVYSKLTMFCTTNSLPMDLLLKQGSLKQEVESFCYQIVSESNDQKVGILQSEDKQLQPSVSKKSEGELSRVKFISNSNKITFSKKPKRRKYDESYLSFGFTYFGNRDAPHAQCVLCKKILSNSSLAPSKLRRHLETKHAAYKDKDISFFKQHLDSPENNKPPTPKIVNTDNESATEASYNVSYHIALSGEAHTIGELLIKPCAKDVVMRMFDEQYSKKIDAVQLSNSTVARRIKDL

SEQ ID NO: 2377 - protein, 255 aa, Homo sapiens
MDRNPSPPPPGRDKEEEEEVAGGDCIGSTVYSKHWLFGVLSGLIQIVSPENTKSSSDDEEQLTELDEEMENEICRVWDMSMDEDVALFLQEFNAPDIFMGVLAKSKCPRLREICVGILGNMACFQEICVSISSDKNLGQVLLHCLYDSDPPTLLETSRLLLTCLSQAEVASVWVERIQEHPAIYDSICFIMSSSTNVDLLVKVGEVVDKLFDLDEKLMLEWVRNGAAQPLDQPQEESEEQPVFRLVPCILEAAKQ

SEQ ID NO: 2378 - protein, 374 aa, Homo sapiens
MESLLQHLDRFSELLAVSSTTYVSTWDPATVRRALQWARYLRHIHRRFGRHGPIRTALERRLHNQWRQEGGFGRGPVPGLANFQALGHCDVLLSLRLLENRALGDAARYHLVQQLFPGPGVRDADEETLQESLARLARRRSAVHMLRFNGYRENPNLQEDSLMKTQAELLLERLQEVGKAEAERPARFLSSLWERLPQNNFLKVIAVALLQPPLSRRPQEELEPGIHKSPGEGSQVLVHWLLGNSEVFAAFCRALPAGLLTLVTSRHPALSPVYLGLLTDWGQRLHYDLQKGIWVGTESQDVPWEELHNRFQSLCQAPPPLKDKVLTALETCKAQDGDFEVPGLSIWTDLLLALRSGAFRKRQVLGLSAGLSSV

SEQ ID NO: 2379 - protein, 197 aa, Homo sapiens
MAALGEPVRLERDICRAIELLEKLQRSGEVPPQKLQALQRVLQSEFCNAVREVYEHVYETVDISSSPEVRANATAKATVAAFAASEGHSHPRVVELPKTEEGLGFNIMGGKEQNSPIYISRIIPGGIADRHGGLKRGDQLLSVNGVSVEGEHHEKAVELLKAAQGKVKLVVRYTPKVLEEMESRFEKMRSAKRRQQT

SEQ ID NO: 2380 - protein, 255 aa, Homo sapiens
MELQTLQEALKVEIQVHQKLVAQMKQDPQNADLKKQLHELQAKITALSEKQKRVVEQLRKNLIVKQEQPDKFQIQPLPQSENKLQTAQQQPLQQLQQQQQYHHHHAQQSAAASPNLTASQKTVTTASMITTKTLPLVLKAATATMPASVVGQRPTIAMVTAINSQKAVLSTDVQNTPVNLQTSSKVTGPGAEAVQIVAKNTVTLVQATPPQPIKVPQFIPPPRLTPRPNFLPQVRPKPVAQNNIPIAPAPPPMLA

SEQ ID NO: 2381 - protein, 255 aa, Homo sapiens
MAAFKLDFLPEMMVDHCSLNSSPVSKKMNGTLDHPDQPDLDAIKMFVGQVPRTWSEKDLRELFEQYGAVYEINVLRDRSQNPPQSKGCCFVTFYTRKAALEAQNALHNMKVLPGMHHPIQMKPADSEKNNVEDRKLFIGMISKKCTENDIRVMFSSFGQIEECRILRGPDGLSRGCAFVTFTTRAMAQTAIKAMHQAQTMEGCSSPMVVKFADTQKDKEQKRMAQQLQQQMQQISAASVWGNLAGLNTLGPQYLA

SEQ ID NO: 2382 - protein, 255 aa, Homo sapiens
MAATELRGVVGPGPAAIAALGGGGAGPPVVGGGGGRGDAGPGSGAASGTVVAAAAGGPGPGAGGVAAAGPAPAPPTGGSGGSGAGGSGSAREGWLFKWTNYIKGYQRRWFVLSNGLLSYYRSKAEMRHTCRGTINLATANITVEDSCNFIISNGGAQTYHLKASSEVERQRWVTALELAKAKAVKMLAESDESGDEESVSQTDKTELQNTLRTLSSKVEDLSTCNDLIAKHGTALQRSLSELESLKLPAESNEKI

SEQ ID NO: 2383 - protein, 255 aa, Homo sapiens
MGKNFSDSFLSRECVIRMVSGRFYLSCLLLGSLGSMCILFTIYWMQYWRGGFAWNGSIYMFNWHPVLMVAGMVVFYGGASLVYRLPQSWVGPKLPWKLLHAALHLMAFVLTVVGLVAVFTFHNHGRTANLYSLHSWLGITTVFLFACQWFLGFAVFLLPWASMWLRSLLKPIHVFFGAAILSLSIASVISGINEKLFFSLKNTTRPYHSLPSEAVFANSTGMLVVAFGLLVLYILLASSWKRPEPGILTDRQPLL

SEQ ID NO: 2384 - protein, 255 aa, Homo sapiens
MSLPIGSAEVASERVELWRSGFRWWQRCLCFCRYRRVAMAAVDSDVESLPRGGFRCCLCHVTTANRPSLDAHLGGRKHRHLVELRAARKAQGLRSVFVSGFPRDVDSAQLSEYFLAFGPVASVVMDKDKGVFAIVEMGDVGAREAVLSQSQHSLGGHRLRVRPREQKEFQSPASKSPKGAAPDSHQLAKALAEAADVGAQMIKLVGLRELSEAERQLRSLVVALMQEVFTEFFPGCVVHPFGSSINSFDVHGCDL

SEQ ID NO: 2385 - protein, 246 aa, Homo sapiens
MVKIYRHESLLGFFKGMSFPIASIAVVNSVLFGVYSNTLLVLTATSHQERRAQPPSYMHIFLAGCTGGFLQAYCLAPFDLIKVRLQNQTEPRAQPGSPPPRYQGPVHCAASIFREEGPRGLFRGAWALTLRDTPTVGIYFITYEGLCRQYTPEGQNPSSATVLVAGGFAGIASWVAATPLDMIKSRMQMDGLRRRVYQGMLDCMVSSIRQEGLGVFFRGVTINSARAFPVNAVTFLSYEYLLRWWG

SEQ ID NO: 2386 - protein, 255 aa, Homo sapiens
MPGPRGAAGGLAPEMRGAGAAGLLALLLLLLLLLLGLGGRVEGGPAGERGAGGGGALARERFKVVFAPVICKRTCLKGQCRDSCQQGSNMTLIGENGHSTDTLTGSGFRVVVCPLPCMNGGQCSSRNQCLCPPDFTGRFCQVPAGGAGGGTGGSGPGLSRTGALSTGALPPLAPEGDSVASKHAIYAVQVIADPPGPGEGPPAQHAAFLVPLGPGQISAEVQAPPPVVNVRVHHPPEASVQVHRIESSNAESAAP

SEQ ID NO: 2387 - protein, 165 aa, Homo sapiens
MSQATKRKHVVKEVLGEHIVPSDQQQIVRVLRTPGNNLHEVETAQGQRFLVSMPSKYRKNIWIKRGDFLIVDPIEEGEKVKAEISFVLCKDHVRSLQKEGFWPEAFSEVAEKHNNRNRQTQPELPAEPQLSGEESSSEDDSDLFVNTNRRQYHESEEESEEEEAA

SEQ ID NO: 2388 - protein, 255 aa, Homo sapiens
MSGGGDVVCTGWLRKSPPEKKLRRYAWKKRWFILRSGRMSGDPDVLEYYKNDHSKKPLRIINLNFCEQVDAGLTFNKKELQDSFVFDIKTSERTFYLVAETEEDMNKWVQSICQICGFNQAEESTDSLRNVSSAGHGPRSSPAELSSSSQHLLRERKSSAPSHSSQPTLFTFEPPVSNHMQPTLSTSAPQEYLYLHQCISRRAENARSASFSQGTRASFLMRSDTAVQKLAQGNGHCVNGISGQVHGFYSLPKPS

SEQ ID NO: 2389 - protein, 255 aa, Homo sapiens
MRHSLTKLLAASGSNSPTRSESPEPAATCSLPSDLTRAAAGEEETAAAGSPGRKQQFGDEGELEAGRGSRGGVAVRAPSPEEMEEEAIASLPGEETEDMDFLSGLELADLLDPRQPDWHLDPGLSSPGPLSSSGGGSDSGGLWRGDDDDEAAAAEMQRFSDLLQRLLNGIGGCSSSSDSGSAEKRRRKSPGGGGGGGSGNDNNQAATKSPRKAAAAAARLNRLKKKEYVMGLESRVRGLAAENQELRAENRELGK

SEQ ID NO: 2390 - protein, 255 aa, Homo sapiens
MSGQSLTDRITAAQHSVTGSAVSKTVCKATTHEIMGPKKKHLDYLIQCTNEMNVNIPQLADSLFERTTNSSWVVVFKSLITTHHLMVYGNERFIQYLASRNTLFNLSNFLDKSGLQGYDMSTFIRRYSRYLNEKAVSYRQVAFDFTKVKRGADGVMRTMNTEKLLKTVPIIQNQMDALLDFNVNSNELTNGVINAAFMLLFKDAIRLFAAYNEGIINLLEKYFDMKKNQCKEGLDIYKKFLTRMTRISEFLKVAE

SEQ ID NO: 2391 - protein, 255 aa, Homo sapiens
MEAAATPAAAGAARREELDMDVMRPLINEQNFDGTSDEEHEQELLPVQKHYQLDDQEGISFVQTLMHLLKGNIGTGLLGLPLAIKNAGIVLGPISLVFIGIISVHCMHILVRCSHFLCLRFKKSTLGYSDTVSFAMEVSPWSCLQKQAAWGRSVVDFFLVITQLGFCSVYIVFLAENVKQVHEGFLESKVFISNSTNSSNPCERRSVDLRIYMLCFLPFIILLVFIRELKNLFVLSFLANVSMAVSLVIIYQYVV

SEQ ID NO: 2392 - protein, 255 aa, Homo sapiens
MIHVRRHETRRNSKSHVPEQKSRVDWRRTKRSSISQLLDSDEELDSEEFDSDEELDSDESFENDEELDSNKGPDCNKTPGSERELNLSKIQSEGNDSKCLINSGNGSTYEEETNKIKHRNIDLQDQEKHLSQEDNDLNKQTGQIIEDDQEKHLSQEDNDLNKQTGQIIEDDLEEEDIKRGKRKRLSSVMCDSDESDDSDILVRKVGVKRPRRVVEDEGSSVEMEQKTPEKTLAAQKREKLQKLKELSKQRSRQRR

SEQ ID NO: 2393 - protein, 255 aa, Homo sapiens
MKQLKRKRKSNFSVQETQTLLKEITKRKEVIFSKQLNTTINVMKRMAWEEIAQCVNAVGEGEQRTGTEVKRRYLDWRALMKRKRMKANIKLVGSGFPLPSSDLDDSLTEEIDEKIGFRNDANFDWQNVADFRDAGGSLTEVKVEEEERDPQSPEFEIEEEEEMLSSVIPDSRRENELPDFPHIDEFFTLNSTPSRSAYDEPHLLVNIEKQKLELEKRRLDIEAERLQVEKERLQIEKERLRHLDMEHERLQLEKE

SEQ ID NO: 2394 - protein, 235 aa, Homo sapiens
MQQRGAAGSRGCALFPLLGVLFFQGVYIVFSLEIRADAHVRGYVGEKIKLKCTFKSTSDVTDKLTIDWTYRPPSSSHTVSIFHYQSFQYPTTAGTFRDRISWVGNVYKGDASISISNPTIKDNGTFSCAVKNPPDVHHNIPMTELTVTERGFGTMLSSVALLSILVFVPSAVVVALLLVRMGRKAAGLKKRSRSGYKKSSIEVSDDTDQEEEEACMARLCVRCAECLDSDYEETY

SEQ ID NO: 2395 - protein, 215 aa, Homo sapiens
MYGKSSTRAVLLLLGIQLTALWPIAAVEIYTSRVLEAVNGTDARLKCTFSSFAPVGDALTVTWNFRPLDGGPEQFVFYYHIDPFQPMSGRFKDRVSWDGNPERYDASILLWKLQFDDNGTYTCQVKNPPDVDGVIGEIRLSVVHTVRFSEIHFLALAIGSACALMIIIVIVVVLFQHYRKKRWAERAHKVVEIKSKEEERLNQEKKVSVYLEDTD

SEQ ID NO: 2396 - protein, 143 aa, Homo sapiens
MSGRGKTGGKARAKAKSRSSRAGLQFPVGRVHRLLRKGHYAERVGAGAPVYLAAVLEYLTAEILELAGNAARDNKKTRIIPRHLQLAIRNDEELNKLLGGVTIAQGGVLPNIQAVLLPKKTSATVGPKAPSGGKKATQASQEY

SEQ ID NO: 2397 - protein, 255 aa, Homo sapiens
MVLQKEPAGAVIWGFGTPGATVTVTLRQGQETIMKKVTSVKAHSDTWMVVLDPMKPGGPFEVMAQQTLEKINFTLRVHDVLFGDVWLCSGQSNMQMTVLQIFNATRELSNTAAYQSVRILSVSPIQAEQELEDLVAVDLQWSKPTSENLGHGYFKYMSAVCWLFGRHLYDTLQYPIGLIASSWGGTPIEAWSSGRSLKACGVPKQGSIPYDSVTGPSKHSVLWNAMIHPLCNMTLKGVVWYQGESNINYNTDLYN

SEQ ID NO: 2398 - protein, 255 aa, Homo sapiens
MGVKTFTHSSSSHSQEMLGKLNMLRNDGHFCDITIRVQDKIFRAHKVVLAACSDFFRTKLVGQAEDENKNVLDLHHVTVTGFIPLLEYAYTATLSINTENIIDVLAAASYMQMFSVASTCSEFMKSSILWNTPNSQPEKGLDAGQENNSNCNFTSRDGSISPVSSECSVVERTIPVCRESRRKRKSYIVMSPESPVKCGTQTSSPQVLNSSASYSENRNQPVDSSLAFPWTFPFGIDRRIQPEKVKQAENTRTLE

SEQ ID NO: 2399 - protein, 434 aa, Homo sapiens
MYELLVLFMLIQPQSMAHPCGGTPTYPESQIFFPTIHERPVSFSPPPTCPPKVAISQRRKSTSFLEAQTHHFQPLLRTVGQSLLPPGGSPTNWTPEAVVMLGTTASRVTGESCEIQVHPMFEPSQVYSDYRPGLVLPEEAHYFIPQEAVYVAGVHYQARVAEQYEGIPYNSSVLSSPMKQIPEQKPVQGGPTSSSVFEFPSGQAFLVGHLQNLRLDSGLGPGSPLSSISAPISTDATRLKFHPVFVPHSAPAVLTHNNESRSNCVFEFHVHTPSSSSGEGGGILPQRVYRNRQVAVDLNQEELPPQSVGLHGYLQPVTEEKHNYHAPELTVSVVEPIGQNWPIGSPEYSSDSSQITSSDPSDFQSPPPTGGAAAPFGSDVSMPFIHLPQTVLQESPLFFCFPQGTTSQQVLTASFSSGGSALHPQVIGKLPQLF

SEQ ID NO: 2400 - protein, 255 aa, Homo sapiens
MNEPTENRLGCSRTPEPDIRLRKGHQLDGTRRGDNDSHQGDLEPILEASVLSSHHKKSSEEHEYSDEAPQEDEGFMGMSPLLQAHHAMEKMEEFVCKVWEGRWRVIPHDVLPDWLKDNDFLLHGHRPPMPSFRACFKSIFRIHTETGNIWTHLLGCVFFLCLGIFYMFRPNISFVAPLQEKVVFGLFFLGAILCLSFSWLFHTVYCHSEGVSRLFSKLDYSGIALLIMGSFVPWLYYSFYCNPQPCFIYLIVICV

SEQ ID NO: 2401 - protein, 255 aa, Homo sapiens
MAPQMYEFHLPLSPEELLKSGGVNQYVVQEVLSIKHLPPQLRAFQAAFRAQGPLAMLQHFDTIYSILHHFRSIDPGLKEDTLQFLIKVVSRHSQELPAILDDTTLSGSDRNAHLNALKMNCYALIRLLESFETMASQTNLVDLDLGGKGKKARTKAAHGFDWEEERQPILQLLTQLLQLDIRHLWNHSIIEEEFVSLVTGCCYRLLENPTINHQKNRPTREAITHLLGVALTRYNHMLSATVKIIQMLQHFEHLA

SEQ ID NO: 2402 - protein, 255 aa, Homo sapiens
MLSRGWFHRDLSGLDAETLLKGRGVHGSFLARPSRKNQGDFSLSVRVGDQVTHIRIQNSGDFYDLYGGEKFATLTELVEYYTQQQGVLQDRDGTIIHLKYPLNCSDPTSERWYHGHMSGGQAETLLQAKGEPWTFLVRESLSQPGDFVLSVLSDQPKAGPGSPLRVTHIKVMCEGGRYTVGGLETFDSLTDLVEHFKKTGIEEASGAFVYLRQPYYATRVNAADIENRVLELNKKQESEDTAKAGFWEEFESLQK

SEQ ID NO: 2403 - protein, 215 aa, Homo sapiens
MGLEKPQSKLEGGMHPQLIPSVIAVVFILLLSVCFIASCLVTHHNFSRCKRGTGVHKLEHHAKLKCIKEKSELKSAEGSTWNCCPIDWRAFQSNCYFPLTDNKTWAESERNCSGMGAHLMTISTEAEQNFIIQFLDRRLSYFLGLRDENAKGQWRWVDQTPFNPRRVFWHKNEPDNSQGENCVVLVYNQDKWAWNDVPCNFEASRICKIPGTTLN

SEQ ID NO: 2404 - protein, 198 aa, Homo sapiens
MSNVRVSNGSPSLERMDARQAEHPKPSACRNLFGPVDHEELTRDLEKHCRDMEEASQRKWNFDFQNHKPLEGKYEWQEVEKGSLPEFYYRPPRPPKGACKVPAQESQDVSGSRPAAPLIGAPANSEDTHLVDPKTDPSDSQTGLAEQCAGIRKRPATDDSSTQNKRANRTEENVSDGSPNAGSVEQTPKKPGLRRRQT

SEQ ID NO: 2405 - protein, 138 aa, Homo sapiens
MISLTDTQKIGMGLTGFGVFFLFFGMILFFDKALLAIGNVLFVAGLAFVIGLERTFRFFFQKHKMKATGFFLGGVFVVLIGWPLIGMIFEIYGFFLLFRGFFPVVVGFIRRVPVLGSLLNLPGIRSFVDKVGESNNMV

SEQ ID NO: 2406 - protein, 255 aa, Homo sapiens
MSTIAAFYGGKSILITGATGFLGKVLMEKLFRTSPDLKVIYILVRPKAGQTLQQRVFQILDSKLFEKVKEVCPNVHEKIRAIYADLNQNDFAISKEDMQELLSCTNIIFHCAATVRFDDTLRHAVQLNVTATRQLLLMASQMPKLEAFIHISTAYSNCNLKHIDEVIYPCPVEPKKIIDSLEWLDDAIIDEITPKLIRDWPNIYTYTKALGEMVVQQESRNLNIAIIRPSIVGATWQEPFPGWVDNINGPNGIII

SEQ ID NO: 2407 - protein, 255 aa, Homo sapiens
MEEIKPASASCVSKEKPSKVSDLISRFEGGSSLSNYSDLKKESAVNLNAPRTPGRHGLTTTPQQKLLSQHLPQRQGNDTDKTQGAQTCVANGVMAAQNQMECEEEKAATLSSDTSIQASEPLLDTHIVNGERDETATAPASPTTDSCDGNASDSSYRTPGIGPVLPLEERGAETETKVQERENGESPLELEQLDQHHEMKETNEQKLHKIANELLLTERAYVNRLDLLDQVFYCKLLEEANRGSFPAEMVNKIFS

SEQ ID NO: 2408 - protein, 231 aa, Homo sapiens [sequence omitted]

SEQ ID NO: 2409 - protein, 255 aa, Homo sapiens
MSHSSVTREAPQLLSQRQRREVRGVWGWGCLPGPRGGPALFGLVTFGQSGDCCTDSGTMNIFDRKINFDALLKFSHITPSTQQHLKKVYASFALCMFVAAAGAYVHMVTHFIQAGLLSALGSLILMIWLMATPHSHETEQKRLGLLAGFAFLTGVGLGPALEFCIAVNPSILPTAFMGTAMIFTCFTLSALYARRRSYLFLGGILMSALSLLLLSSLGNVFFGSIWLFQANLYVGLVVMCGFVLFDTQLIIEKAE

SEQ ID NO: 2410 - protein, 57 aa, Homo sapiens
MPTGKQLADIGYKTFSTSMMLLTVYGGYLCSVRVYHYFQWRRAQRQAAEEQKTSGIM

SEQ ID NO: 2411 - protein, 148 aa, Homo sapiens
MWNPNAGQPGPNPYPPNIGCPGGSNPAHPPPINPPFPPGPCPPPPGAPHGNPAFPPGGPPHPVPQPGYPGCQPLGPYPPPYPPPAPGIPPVNPLAPGMVGPAVIVDKKMQKKMKKAHKKMHKHQKHHKYHKHGKHSSSSSSSSSSDSD

SEQ ID NO: 2412 - protein, 735 aa, Homo sapiens
MAKERGLISPSDFAQLQKYMEYSTKKVSDVLKLFEDGEMAKYVQGDAIGYEGFQQFLKIYLEVDNVPRHLSLALFQSFETGHCLNETNVTKDVVCLNDVSCYFSLLEGGRPEDKLEFTFKLYDTDRNGILDSSEVDKIILQMMRVAEYLDWDVSELRPILQEMMKEIDYDGSGSVSQAEWVRAGATTVPLLVLLGLEMTLKDDGQHMWRPKRFPRPVYCNLCESSIGLGKQGLSCNLCKYTVHDQCAMKALPCEVSTYAKSRKDIGVQSHVWVRGGCESGRCDRCQKKIRIYHSLTGLHCVWCHLEIHDDCLQAVGHECDCGLLRDHILPPSSIYPSVLASGPDRKNSKTSQKTMDDLNLSTSEALRIDPVPNTHPLLVFVNPKSGGKQGQRVLWKFQYILNPRQVFNLLKDGPEIGLRLFKDVPDSRILVCGGDGTVGWILETIDKANLPVLPPVAVLPLGTGNDLARCLRWGGGYEGQNLAKILKDLEMSKVVHMDRWSVEVIPQQTEEKSDPVPFQIINNYFSIGVDASIAHRFYIMREKYPEKFNSRMKNKLWYFEFATSESIFSTCKKLEESLTVEICGKPLDLSNLSLEGIAVLNIPSMHGGSNLWGDTRRPHGDIYGINQALGATAKVITDPDILKTCVPDLSDKRLEVVGLEGAIEMGQIYTKLKNAGRRLAKCSEITFHTTKTLPMQIDGEPWMQTPCTIKITHKNQMPMLMGPPPRSTNFFGFLS

SEQ ID NO: 2413 - protein, 247 aa, Homo sapiens
MAWAGSRRVPAGTRAAAERCCRLSLSPGAQPAPPPGPLPPPRPMRFLTSCSLLLPRAAQILAAEAGLPSSRSFMGFAAPFTNKRKAYSERRIMGYSMQEMYEVVSNVQEYREFVPWCKKSLVVSSRKGHLKAQLEVGFPPVMERYTSAVSMVKPHMVKAVCTDGKLFNHLETIWRFSPGIPAYPRTCTVDFSISFEFRSLLHSQLATMFFDEVVKQNVAAFERRAATKFGPETAIPRELMFHEVHQT

SEQ ID NO: 2414 - protein, 210 aa, Homo sapiens
MVCGGFACSKNALCALNVVYMLVSLLLIGVAAWGKGLGLVSSIHIIGGVIAVGVFLLLIAVAGLVGAVNHHQVLLFFYMIILGLVFIFQFVISCSCLAINRSKQTDVINASWWVMSNKTRDELERSFDCCGLFNLTTLYQQDYDFCTAICKSQSPTCQMCGEKFLKHSDEALKILGGVGLFFSFTEILGVWLAMRFRNQKDPRANPSAFL

SEQ ID NO: 2415 - protein, 255 aa, Homo sapiens
MLKSRLRMFLNELKLLVLTGGGRPRAEPQPRGGRGGGCGWAPFAGCSTRDGDGDEEEYYGSEPRARGLAGDKEPRAGPLPPPAPPLPPPGALDALSLSSSLDSGLRTPQCRICFQGPEQGELLSPCRCDGSVRCTHQPCLIRWISERGSWSCELCYFKYQVLAISTKNPLQWQAISLTVIEKVQIAAIVLGSLFLVASISWLIWSSLSPSAKWQRQDLLFQICYGMYGFMDVVCIGLIIHEGSSVYRIFKRWQAV

SEQ ID NO: 2416 - protein, 255 aa, Homo sapiens
MAAAAASAPQQLSDEELFSQLRRYGLSPGPVTESTRPVYLKKLKKLREEEQQQHRSGGRGNKTRNSNNNNTAAATVAAAGPAAAAAAGMGVRPVSGDLSYLRTPGGLCRISASGPESLLGGPGGASAAPAAGSKVLLGFSSDESDVEASPRDQAGGGGRKDRASLQYRGLKAPPAPLAASEVTNSNSAERRKPHSWWGARRPAGPELQTPPGKDGAVEDEEGEGEDGEERDPETEEPLWASRTVNGSRLVPYSCR

SEQ ID NO: 2417 - protein, 596 aa, Homo sapiens
MAGNCGARGALSAHTLLFDLPPALLGELCAVLDSCDGALGWRGLAERLSSSWLDVRHIEKYVDQGKSGTRELLWSWAQKNKTIGDLLQVLQEMGHRRAIHLITNYGAVLSPSEKSYQEGGFPNILFKETANVTVDNVLIPEHNEKGVLLKSSISFQNIIEGTRNFHKDFLIGEGEIFEVYRVEIQNLTYAVKLFKQEKKMQCKKHWKRFLSELEVLLLFHHPNILELAAYFTETEKFCLIYPYMRNGTLFDRLQCVGDTAPLPWHIRIGILIGISKAIHYLHNVQPCSVICGSISSANILLDDQFQPKLTDFAMAHFRSHLEHQSCTINMTSSSSKHLWYMPEEYIRQGKLSIKTDVYSFGIVIMEVLTGCRVVLDDPKHIQLRDLLRELMEKRGLDSCLSFLDKKVPPCPRNFSAKLFCLAGRCAATRAKLRPSMDEVLNTLESTQASLYFAEDPPTSLKSFRCPSPLFLENVPSIPVEDDESQNNNLLPSDEGLRIDRMTQKTPFECSQSEVMFLSLDKKPESKRNEEACNMPSSSCEESWFPKYIVPSQDLRPYKVNIDPSSEAPGHSCRSRPVESSCSSKFSWDEYEQYKKE

SEQ ID NO: 2418 - protein, 255 aa, Homo sapiens
MANINLKEITLIVGVVTACYWNSLFCGFVFDDVSAILDNKDLHPSTPLKTLFQNDFWGTPMSEERSHKSYRPLTVLTFRLNYLLSELKPMSYHLLNMIFHAVVSVIFLKVCKLFLDNKSSVIASLLFAVHPIHTEAVTGVVGRAELLSSIFFLAAFLSYTRSKGPDNSIIWTPIALTVFLVAVATLCKEQGITVVGICCVYEVFIAQGYTLPLLCTTAGQFLRGKGSIPFSMLQTLVKLIVLMFSTLLLVVIRVQ

SEQ ID NO: 2419 - protein, 255 aa, Homo sapiens
MTTLVLDNGAYNAKIGYSHENVSVIPNCQFRSKTARLKTFTANQIDEIKDPSGLFYILPFQKGYLVNWDVQRQVWDYLFGKEMYQVDFLDTNIIITEPYFNFTSIQESMNEILFEEYQFQAVLRVNAGALSAHRYFRDNPSELCCIIVDSGYSFTHIVPYCRSKKKKEAIIRINVGGKLLTNHLKEIISYRQLHVMDETHVINQVKEDVCYVSQDFYRDMDIAKLKGEENTVMIDYVLPDFSTIKKGFCKPREEM

SEQ ID NO: 2420 - protein, 189 aa, Homo sapiens
MCQLLESTVIQPQGDSPVAVLCVCDLSPAQCDINCCCDPDCSSVDFSVFSACSVPVVTGDSQFCSQKAVIYSLNFTANPPQRVFELVDQINPSIFCIHITNYKPALSFINPEVPDENNFDTLMKTSDGFTLNAESYVSFTTKLDIPTAAKYEVSLNLIDSFHPITNIFPCKLIFKVTRKTGFLETELIL

SEQ ID NO: 2421 - protein, 195 aa, Homo sapiens
MAPAASRLRAEAGLGALPRRALAQYLLFLRLYPVLTKAATSGILSALGNFLAQMIEKKRKKENSRSLDVGGPLRYAVYGFFFTGPLSHFFYFFMEHWIPPEVPLAGLRRLLLDRLVFAPAFLMLFFLIMNFLEGKDASAFAAKMRGGFWPALRMNWRVWTPLQFININYVPLKFRVLFANLAALFWYAYLASLGK

SEQ ID NO: 2422 - protein, 255 aa, Homo sapiens
MAAVAAGGLVGKGRDISLAALQRHDPYINRIVDVASQVALYTFGHRANEWEKTDVEGTLFVYTRSASPKHGFTIMNRLSMENRTEPITKDLDFQLQDPFLLYRNARLSIYGIWFYDKEECQRIAELMKNLTQYEQLKAHQGTGAGISPVILNSGEGKEVDILRMLIKAKDEYTKCKTCSEPKKITSSSAIYDNPNLIKPIPVKPSENQQQRIPQPNQTLDPEPQHLSLTALFGKQDKATCQETVEPPQTLHQQQQ

SEQ ID NO: 2423 - protein, 255 aa, Homo sapiens
MGTQKVTPALIFAITVATIGSFQFGYNTGVINAPEKIIKEFINKTLTDKGNAPPSEVLLTSLWSLSVAIFSVGGMIGSFSVGLFVNRFGRRNSMLIVNLLAVTGGCFMGLCKVAKSVEMLILGRLVIGLFCGLCTGFVPMYIGEISPTALRGAFGTLNQLGIVVGILVAQIFGLEFILGSEELWPLLLGFTILPAILQSAALPFCPESPRFLLINRKEEENAKQILQRLWGTQDVSQDIQEMKDESARMSQEKQV

SEQ ID NO: 2424 - protein, 255 aa, Homo sapiens
MASFSAETNSTDLLSQPWNEPPVILSMVILSLTFLLGLPGNGLVLWVAGLKMQRTVNTIWFLHLTLADLLCCLSLPFSLAHLALQGQWPYGRFLCKLIPSIIVLNMFASVFLLTAISLDRCLVVFKPIWCQNHRNVGMACSICGCIWVVAFVMCIPVFVYREIFTTDNHNRCGYKFGLSSSLDYPDFYGDPLENRSLENIVQPPGEMNDRLDPSSFQTNDHPWTVPTVFQPQTFQRPSADSLPRGSARLTSQNLY

SEQ ID NO: 2425 - protein, 255 aa, Homo sapiens
MTRGGPGGRPGLPQPPPLLLLLLLLPLLLVTAEPPKPAGVYYATAYWMPAEKTVQVKNVMDKNGDAYGFYNNSVKTTGWGILEIRAGYGSQTLSNEIIMFVAGFLEGYLTAPHMNDHYTNLYPQLITKPSIMDKVQDFMEKQDKWTRKNIKEYKTDSFWRHTGYVMAQIDGLYVGAKKRAILEGTKPMTLFQIQFLNSVGDLLDLIPSLSPTKNGSLKVFKRWDMGHCSALIKVLPGFENILFAHSSWYTYAAML

SEQ ID NO: 2426 - protein, 255 aa, Homo sapiens
MGFLQLLVVAVLASEHRVAGAAEVFGNSSEGLIEFSVGKFRYFELNRPFPEEAILHDISSNVTFLIFQIHSQYQNTTVSFSPTLLSNSSETGTASGLVFILRPEQSTCTWYLGTSGIQPVQNMAILLSYSERDPVPGGCNLEFDLDIDPNIYLEYNFFETTIKFAPANLGYARGVDPPPCDAGTDQDSRWRLQYDVYQYFLPENDLTEEMLLKHLQRMVSVPQVKASALKVVTLTANDKTSVSFSSLPGQGVIYN

SEQ ID NO: 2427 - protein, 255 aa, Homo sapiens
MSSSMWYIMQSIQSKYSLSERLIRTIAAIRSFPHDNVEDLIRGGADVNCTHGTLKPLHCACMVSDADCVELLLEKGAEVNALDGYNRTALHYAAEKDEACVEVLLEYGANPNALDGNRDTPLHWAAFKNNAECVRALLESGASVNALDYNNDTPLSWAAMKGNLESVSILLDYGAEVRVINLIGQTPISRLVALLVRGLGTEKEDSCFELLHRAVGHFELRKNGTMPREVARDPQLCEKLTVLCSAPGTLKTLAR

SEQ ID NO: 2428 - protein, 255 aa, Homo sapiens
MEAPDYEVLSVREQLFHERIRECIISTLLFATLYILCHIFLTRFKKPAEFTTVDDEDATVNKIALELCTFTLAIALGAVLLLPFSIISNEVLLSLPRNYYIQWLNGSLIHGLWNLVFLFSNLSLIFLMPFAYFFTESEGFAGSRKGVLGRVYETVVMLMLLTLLVLGMVWVASAIVDKNKANRESLYDFWEYYLPYLYSCISFLGVLLLLVCTPLGLARMFSVTGKLLVKPRLLEDLEEQLYCSAFEEAALTRRI

SEQ ID NO: 2429 - protein, 255 aa, Homo sapiens
MGNLESAEGVPGEPPSVPLLLPPGKMPMPEPCELEERFALVLSSMNLPPDKARLLRQYDNEKKWDLICDQERFQVKNPPHTYIQKLQSFLDPSVTRKKFRRRVQESTKVLRELEISLRTNHIGWVREFLNDENKGLDVLVDYLSFAQCSVMFDFEGLESGDDGAFDKLRSWSRSIEDLQPPSALSAPFTNSLARSARQSVLRYSTLPGRRALKNSRLVSQKDDVHVCILCLRAIMNYQYGFNLVMSHPHAVNEIA

SEQ ID NO: 2430 - protein, 255 aa, Homo sapiens
MCSLGLFPPPPPRGQVTLYEHNNELVTGSSYESPPPDFRGQWINLPVLQLTKDPLKTPGRLDHGTRTAFIHHREQVWKRCINIWRDVGLFGVLNEIANSEEEVFEWVKTASGWALALCRWASSLHGSLFPHLSLRSEDLIAEFAQVTNWSSCCLRVFAWHPHTNKFAVALLDDSVRVYNASSTIVPSLKHRLQRNVASLAWKPLSASVLAVACQSCILIWTLDPTSLSTRPSSGCAQVLSHPGHTPVTSLAWAPS

SEQ ID NO: 2431 - protein, 255 aa, Homo sapiens
MSPCPPQQSRNRVIQLSTSELGEMELTWQEIMSITELQGLNAPSEPSFEPQAPAPYLGPPPPTTYCPCSIHPDSGFPLPPPPYELPASTSHVPDPPYSYGNMAIPVSKPLSLSGLLSEPLQDPLALLDIGLPAGPPKPQEDPESDSGLSLNYSDAESLELEGTEAGRRRSEYVEMYPVEYPYSLMPNSLAHSNYTLPAAETPLALEPSSGPVRAKPTARGEAGSRDERRALAMKIPFPTDKIVNLPVDDFNELLA

SEQ ID NO: 2432 - protein, 255 aa, Homo sapiens
MWNSSDANFSCYHESVLGYRYVAVSWGVVVAVTGTVGNVLTLLALAIQPKLRTRFNLLIANLTLADLLYCTLLQPFSVDTYLHLHWRTGATFCRVFGLLLFASNSVSILTLCLIALGRYLLIAHPKLFPQVFSAKGIVLALVSTWVVGVASFAPLWPIYILVPVVCTCSFDRIRGRPYTTILMGIYFVLGLSSVGIFYCLIHRQVKRAAQALDQYKLRQASIHSNHVARTDEAMPGRFQELDSRLASGGPSEGIS

SEQ ID NO: 2433 - protein, 156 aa, Homo sapiens
MITFAIFLSLIMLVEVAAAIAGYVFRDKVMSEFNNNFRQQMENYPKNNHTASILDRMQADFKCCGAANYTDWEKIPSMSKNRVPDSCCINVTVGCGINFNEKAIHKEGCVEKIGGWLRKNVLVVAAAALGIAFVEVLGIVFACCLVKSIRSGYEVM

SEQ ID NO: 2434 - protein, 153 aa, Homo sapiens
MNVGVAHSEVNPNTRVMNSRGIWLAYIILVGLLHMVLLSIPFFSIPVVWTLTNVIHNLATYVFLHTVKGTPFETPDQGKARLLTHWEQMDYGLQFTSSRKFLSISPIVLYLLASFYTKYDAAHFLINTASLLSVLLPKLPQFHGVRVFGINKY

SEQ ID NO: 2435 - protein, 255 aa, Homo sapiens
MPGEATETVPATEQELPQPQAETAVLPMSSALSVTAALGQPGPTLPPPCSPAPQQCPLSAANQASPFPSPSTIASTPLEVPFPQSSSGTALPLGTAPEAPTFLPNLIGPPISPAALALASPMIAPTLKGTPSSSAPLALVALAPHSVQKSSAFPPNLLTSPPSVAVAESGSVITLSAPIAPSEPKTNLNKVPSEVVPNPKGTPSPPCIVSTVPYHCVTPMASIQSGVASLPQTTPTTTLAIASPQVKDTTISSVL

SEQ ID NO: 2436 - protein, 255 aa, Homo sapiens
MATSRYEPVAEIGVGAYGTVYKARDPHSGHFVALKSVRVPNGGGGGGGLPISTVREVALLRRLEAFEHPNVVRLMDVCATSRTDREIKVTLVFEHVDQDLRTYLDKAPPPGLPAETIKDLMRQFLRGLDFLHANCIVHRDLKPENILVTSGGTVKLADFGLARIYSYQMALTPVVVTLWYRAPEVLLQSTYATPVDMWSVGCIFAEMFRRKPLFCGNSEADQLGKIFDLIGLPPEDDWPRDVSLPRGAFPPRGPR

SEQ ID NO: 2437 - protein, 238 aa, Homo sapiens
MADPDPRYPRSSIEDDFNYGSSVASATVHIRMAFLRKVYSILSLQVLLTTVTSTVFLYFESVRTFVHESPALILLFALGSLGLIFALILNRHKYPLNLYLLFGFTLLEALTVAVVVTFYDVYIILQAFILTTTVFFGLTVYTLQSKKDFSKFGAGLFALLWILCLSGFLKFFFYSEIMELVLAAAGALLFCGFIIYDTHSLMHKLSPEEYVLAAISLYLDIINLFLHLLRFLEAVNKK

SEQ ID NO: 2438 - protein, 179 aa, Homo sapiens
MAALQKSVSSFLMGTLATSCLLLLALLVQGGAAAPISSHCRLDKSNFQQPYITNRTFMLAKEASLADNNTDVRLIGEKLFHGVSMSERCYLMKQVLNFTLEEVLFPQSDRFQPYMQEVVPFLARLSNRLSTCHIEGDDLHIQRNVQKLKDTVKKLGESGEIKAIGELDLLFMSLRNACI

SEQ ID NO: 2439 - protein, 233 aa, Homo sapiens
MLKPSVTSAPTADMATLTVVQPLTLDRDVARAIELLEKLQESGEVPVHKLQSLKKVLQSEFCTAIREVYQYMHETITVNGCPEFRARATAKATVAAFAASEGHSHPRVVELPKTDEGLGFNVMGGKEQNSPIYISRIIPGGVAERHGGLKRGDQLLSVNGVSVEGEHHEKAVELLKAAKDSVKLVVRYTPKVLEEMEARFEKLRTARRRQQQQLLIQQQQQQQQQQTQQNHMS

SEQ ID NO: 2440 - protein, 255 aa, Homo sapiens
MPRYTVHVRGEWLAVPCQDAQLTVGWLGREAVRRYIKNKPDNGGFTSVDDAHFLVRRCKGLGLLDNEDRLEVALENNEFVEVVIEGDAMSPDFIPSQPEGVYLYSKYREPEKYIELDGDRLTTEDLVNLGKGRYKIKLTPTAEKRVQKSREVIDSIIKEKTVVYGITTGFGKFARTVIPINKLQELQVNLVRSHSSGVGKPLSPERCRMLLALRINVLAKGYSGISLETLKQVIEMFNASCLPYVPEKGTVGASG

SEQ ID NO: 2441 - protein, 255 aa, Homo sapiens
MPAVDKLLLEEALQDSPQTRSLLSVFEEDAGTLTDYTNQLLQAMQRVYGAQNEMCLATQQLSKQLLAYEKQNFALGKGDEEVISTLHYFSKVVDELNLLHTELAKQLADTMVLPIIQFREKDLTEVSTLKDLFGLASNEHDLSMAKYSRLPKKKENEKVKTEVGKEVAAARRKQHLSSLQYYCALNALQYRKQMAMMEPMIGFAHGQINFFKKGAEMFSKRMDSFLSSVADMVQSIQVELEAEAEKMRVSQQELL

SEQ ID NO: 2442 - protein, 209 aa, Homo sapiens
MALLAEHLLKPLPADKQIETGPFLEAVSHLPPFFDCLGSPVFTPIKADISGNITKIKAVYDTNPAKFRTLQNILEVEKEMYGAEWPKVGATLALMWLKRGLRFIQVFLQSICDGERDENHPNLIRVNATKAYEMALKKYHGWIVQKIFQAALYAAPYKSDFLKALSKGQNVTEEECLEKIRLFLVNYTATIDVIYEMYTQMNAELNYKV

SEQ ID NO: 2443 - protein, 255 aa, Homo sapiens
MSKRLRSSEVCADCSGPDPSWASVNRGTFLCDECCSVHRSLGRHISQVRHLKHTPWPPTLLQMVETLYNNGANSIWEHSLLDPASIMSGRRKANPQDKVHPNKAEFIRAKYQMLAFVHRLPCRDDDSVTAKDLSKQLHSSVRTGNLETCLRLLSLGAQANFFHPEKGNTPLHVASKAGQILQAELLAVYGADPGTQDSSGKTPVDYARQGGHHELAERLVEIQYELTDRLAFYLCGRKPDHKNGQHFIIPQMADS

SEQ ID NO: 2444 - protein, 186 aa, Homo sapiens
MAGHRLVLVLGDLHIPHRCNSLPAKFKKLLVPGKIQHILCTGNLCTKESYDYLKTLAGDVHIVRGDFDENLNYPEQKVVTVGQFKIGLIHGHQVIPWGDMASLALLQRQFDVDILISGHTHKFEAFEHENKFYINPGSATGAYNALETNIIPSFVLMDIQASTVVTYVYQLIGDDVKVERIEYKKP

SEQ ID NO: 2445 - protein, 255 aa, Homo sapiens
MFSVLSYGRLVARAVLGGLSQTDPRAGGGGGGDYGLVTAGCGFGKDFRKGLLKKGACYGDDACFVARHRSADVLGVADGVGGWRDYGVDPSQFSGTLMRTCERLVKEGRFVPSNPIGILTTSYCELLQNKVPLLGSSTACIVVLDRTSHRLHTANLGDSGFLVVRGGEVVHRSDEQQHYFNTPFQLSIAPPEAEGVVLSDSPDAADSTSFDVQLGDIILTATDGLFDNMPDYMILQELKKLKNSNYESIQQTARS

SEQ ID NO: 2446 - protein, 255 aa, Homo sapiens
MAADKGPAAGPRSRAAMAQWRKKKGLRKRRGAASQARGSDSEDGEFEIQAEDDARARKLGPGRPLPTFPTSECTSDVEPDTREMVRAQNKKKKKSGGFQSMGLSYPVFKGIMKKGYKVPTPIQRKTIPVILDGKDVVAMARTGSGKTACFLLPMFERLKTHSAQTGARALILSPTRELALQTLKFTKELGKFTGLKTALILGGDRMEDQFAALHENPDIIIATPGRLVHVAVEMSLKLQSVEYVVFDEADRLFEM

SEQ ID NO: 2447 - protein, 255 aa, Homo sapiens
MAGRRLNLRWALSVLCVLLMAETVSGTRGSSTGAHISPQFPASGVNQTPVVDCRKVCGLNVSDRCDFIRTNPDCHSDGGYLDYLEGIFCHFPPSLLPLAVTLYVSWLLYLFLILGVTAAKFFCPNLSAISTTLKLSHNVAGVTFLAFGNGAPDIFSALVAFSDPHTAGLALGALFGAGVLVTTVVAGGITILHPFMAASRPFFRDIVFYMVAVFLTFLMLFRGRVTLAWALGYLGLYVFYVVTVILCTWIYQRQR

SEQ ID NO: 2448 - protein, 255 aa, Homo sapiens
MMSGEPLHVKTPIRDSMALSKMAGTSVYLKMDSAQPSGSFKIRGIGHFCKRWAKQGCAHFVCSSAGNAGMAAAYAARQLGVPATIVVPSTTPALTIERLKNEGATVKVVGELLDEAFELAKALAKNNPGWVYIPPFDDPLIWEGHASIVKELKETLWEKPGAIALSVGGGGLLCGVVQGLQEVGWGDVPVIAMETFGAHSFHAATTAGKLVSLPKITSVAKALGVKTVGAQALKLFQEHPIFSEVISDQEAVAAI

SEQ ID NO: 2449 - protein, 255 aa, Homo sapiens
MSRLIVKNLPNGMKEERFRQLFAAFGTLTDCSLKFTKDGKFRKFGFIGFKSEEEAQKAQKHFNKSFIDTSRITVEFCKSFGDPAKPRAWSKHAQKPSQPKQPPKDSTTPEIKKDEKKKKVAGQLEKLKEDTEFQEFLSVHQRRAQAATWANDGLDAEPSKGKSKPASDYLNFDSDSGQESEEEGAGEDLEEEASLEPKAAVQKELSDMDYLKSKMVKAGSSSSSEEEESEDEAVHCDEGSEAEEEDSSATPVLQE

SEQ ID NO: 2450 - protein, 255 aa, Homo sapiens
MTAAANWVANGASLEDCHSNLFSLAELTGIKWRRYNFGGHGDCGPIISAPAQDDPILLSFIRCLQANLLCVWRRDVKPDCKELWIFWWGDEPNLVGVIHHELQVVEEGLWENGLSYECRTLLFKAIHNLLERCLMDKNFVRIGKWFVRPYEKDEKPVNKSEHLSCAFTFFLHGESNVCTSVEIAQHQPIYLINEEHIHMAQSSPAPFQVLVSPYGLNGTLTGQAYKMSDPATRKLIEEWQYFYPMVLKKKEESKE

SEQ ID NO: 2451 - protein, 205 aa, Homo sapiens
MVNLAAMVWRRLLRKRWVLALVFGLSLVYFLSSTFKQEERAVRDRNLLQVHDHNQPIPWKVQFNLGNSSRPSNQCRNSIQGKHLITDELGYVCERKDLLVNGCCNVNVPSTKQYCCDGCWPNGCCSAYEYCVSCCLQPNKQLLLERFLNRAAVAFQNLFMAVEDHFELCLAKCRTSSQSVQHENTYRDPIAKYCYGESPPELFPA

SEQ ID NO: 2452 - protein, 255 aa, Homo sapiens
MAAAAVDSAMEVVPALAEEAAPEVAGLSCLVNLPGEVLEYILCCGSLTAADIGRVSSTCRRLRELCQSSGKVWKEQFRVRWPSLMKHYSPTDYVNWLEEYKVRQKAGLEARKIVASFSKRFFSEHVPCNGFSDIENLEGPEIFFEDELVCILNMEGRKALTWKYYAKKILYYLRQQKILNNLKAFLQQPDDYESYLEGAVYIDQYCNPLSDISLKDIQAQIDSIVELVCKTLRGINSRHPSLAFKAGESSMIMEI

SEQ ID NO: 2453 - protein, 255 aa, Homo sapiens
MEAGEEPLLLAELKPGRPHQFDWKSSCETWSVAFSPDGSWFAWSQGHCIVKLIPWPLEEQFIPKGFEAKSRSSKNETKGRGSPKEKTLDCGQIVWGLAFSPWPSPPSRKLWARHHPQVPDVSCLVLATGLNDGQIKIWEVQTGLLLLNLSGHQDVVRDLSFTPSGSLILVSASRDKTLRIWDLNKHGKQIQVLSGHLQWVYCCSISPDCSMLCSAAGEKSVFLWSMRSYTLIRKLEGHQSSVVSCDFSPDSALLV

SEQ ID NO: 2454 - protein, 255 aa, Homo sapiens
MRKGVLKDPEIADLFYKDDPEELFIGLHEIGHGSFGAVYFATNAHTSEVVAIKKMSYSGKQTHEKWQDILKEVKFLRQLKHPNTIEYKGCYLKEHTAWLVMEYCLGSASDLLEVHKKPLQEVEIAAITHGALHGLAYLHSHALIHRDIKAGNILLTEPGQVKLADFGSASMASPANSFVGTPYWMAPEVILAMDEGQYDGKVDIWSLGITCIELAERKPPLFNMNAMSALYHIAQNDSPTLQSNEWTDSFRRFVD

SEQ ID NO: 2455 - protein, 255 aa, Homo sapiens
MLKFKYGARNPLDAGAAEPIASRASRLNLFFQGKPPFMTQQQMSPLSREGILDALFVLFEECSQPALMKIKHVSNFVRKYSDTIAELQELQPSAKDFEVRSLVGCGHFAEVQVVREKATGDIYAMKVMKKKALLAQEQVSFFEEERNILSRSTSPWIPQLQYAFQDKNHLYLVMEYQPGGDLLSLLNRYEDQLDENLIQFYLAELILAVHSVHLMGYVHRDIKPENILVDRTGHIKLVDFGSAAKMNSNKMVNAK

SEQ ID NO: 2456 - protein, 201 aa, Homo sapiens
MARDYDHLFKLLIIGDSGVGKSSLLLRFADNTFSGSYITTIGVDFKIRTVEINGEKVKLQIWDTAGQERFRTITSTYYRGTHGVIVVYDVTSAESFVNVKRWLHEINQNCDDVCRILVGNKNDDPERKVVETEDAYKFAGQMGIQLFETSAKENVNVEEMFNCITELVLRAKKDNLAKQQQQQQNDVVKLTKNSKRKKRCC

SEQ ID NO: 2457 - protein, 255 aa, Homo sapiens
MPREDRATWKSNYFLKIIQLLDDYPKCFIVGADNVGSKQMQQIRMSLRGKAVVLMGKNTMMRKAIRGHLENNPALEKLLPHIRGNVGFVFTKEDLTEIRDMLLANKVPAAARAGAIAPCEVTVPAQNTGLGPEKTSFFQALGITTKISRGTIEILGVRNVASVCLQIGYPTVASVPHSIINGYKRVLALSVETDYTFPLAEKVKAFLADPSAFVAAAPVAAATTAAPAAAAAPAKVEAKEESEESDEDMGFGLFD

SEQ ID NO: 2458 - protein, 262 aa, Homo sapiens
MPDTFNSRSPSVEGSLWAVGTESQGRDWRHLPTITSELSGAPRCHTVPCAGSTALQEPGEPQGPPASPSCPEEALAATWEQPWASEVFGPERMPPSGAARSFQEVTEPAVVAVDRQAIFPDTWTLTEEHGLQQERPRPEPGRLGSSSPASVTTEQLGAKMTERGSVARPTQGPETPRSPEGTTEAATQDGKEQPELPCAMAMGTPSTTERISTSGQAGTSSHGCWAWPLAGLSVGRSSLTACSLPLCACLLGQKMLRHCGRT

SEQ ID NO: 2459 - protein, 76 aa, Homo sapiens
MNSVGEACTDMKREYDQCFNRWFAEKFLKGDSSGDPCTDLFKRYQQCVQKAIKEKEIPIEGLEFMGHGKEKPENSS

SEQ ID NO: 2460 - protein, 136 aa, Homo sapiens
MWSRLVWLGLRAPLGGRQGFTSKADPQGSGRITAAVIEHLERLALVDFGSREAVARLEKAIAFADRLRAVDTDGVEPMESVLEDRCLYLRSDNVVEGNCADELLQNSHRVVEEYFVAPPGNISLPKLDEQEPFPHS

SEQ ID NO: 2461 - protein, 113 aa, Homo sapiens
MVRFKHRYLLCELVSDDPRCRLSLDDRVLSSLVRDTIARVHGTFGAAACSIGFAGTIRTCQKFLIQYNRRQLLILLQNCTDEGEREAIQKSVTRSCLLEEEEESGEEAAEAME

SEQ ID NO: 2462 - protein, 255 aa, Homo sapiens
MAEQTYSWAYSLVDSSQVSTFLISILLIVYGSFRSLNMDFENQDKEKDSNSSSGSFNGNSTNNSIQTIDSTQALFLPIGASVSLLVMFFFFDSVQVVFTICTAVLATIAFAFLLLPMCQYLTRPCSPQNKISFGCCGRFTAAELLSFSLSVMLVLIWVLTGHWLLMDALAMGLCVAMIAFVRLPSLKVSCLLLSGLLIYDVFWVFFSAYIFNSNVMVKVATQPADNPLDVLSRKLHLGPNVGRDVPRLSLPGKLV

SEQ ID NO: 2463 - protein, 255 aa, Homo sapiens
MVSKLSQLQTELLAALLESGLSKEALIQALGEPGPYLLAGEGPLDKGESCGGGRGELAELPNGLGETRGSEDETDDDGEDFTPPILKELENLSPEEAAHQKAVVETLLQEDPWRVAKMVKSYLQQHNIPQREVVDTTGLNQSHLSQHLNKGTPMKTQKRAALYTWYVRKQREVAQQFTHAGQGGLIEEPTGDELPTKKGRRNRFKWGPASQQILFQAYERQKNPSKEERETLVEECNRAECIQRGVSPSQAQGLG

SEQ ID NO: 2464 - protein, 255 aa, Homo sapiens
MASVHESLYFNPMMTNGVVHANVFGIKDWVTPYKIAVLVLLNEMSRTGEGAVSLMERRRLNQLLLPLLQGPDITLSKLYKLIEESCPQLANSVQIRIKLMAEGELKDMEQFFDDLSDSFSGTEPEVHKTSVVGLFLRHMILAYSKLSFSQVFKLYTALQQYFQNGEKKTVEDADMELTSRDEGERKMEKEELDVSVREEEVSCSGPLSQKQAEFFLSQQASLLKNDETKALTPASLQKELNNLLKFNPDFAEAHY

SEQ ID NO: 2465 - protein, 255 aa, Homo sapiens
MAGPQMGGSAEDHPPRKRHAAEKQKKKTVIYTKCFEFESATQRPIDRQRYDENEDLSDVEEIVSVRGFSLEEKLRSQLYQGDFVHAMEGKDFNYEYVQREALRVPLIFREKDGLGIKMPDPDFTVRDVKLLVGSRRLVDVMDVNTQKGTEMSMSQFVRYYETPEAQRDKLYNVISLEFSHTKLEHLVKRPTVVDLVDWVDNMWPQHLKEKQTEATNAIAEMKYPKVKKYCLMSVKGCFTDFHIDFGGTSVWYHVF

SEQ ID NO: 2466 - protein, 240 aa, Homo sapiens
MPVSKCPKKSESLWKGWDRKAQRNGLRSQVYAVNGDYYVGEWKDNVKHGKGTQVWKKKGAIYEGDWKFGKRDGYGTLSLPDQQTGKCRRVYSGWWKGDKKSGYGIQFFGPKEYYEGDWCGSQRSGWGRMYYSNGDIYEGQWENDKPNGEGMLRLKNGNRYEGCWERGMKNGAGRFFHLDHGQLFEGFWVDNMAKCGTMIDFGRDEAPEPTQFPIPEVKILDPDGVLAEALAMFRKTEEGD

SEQ ID NO: 2467 - protein, 255 aa, Homo sapiens
MSGQLERCEREWHELEGEFQELQETHRIYKQKLEELAALQTLCSSSISKQKKHLKDLKLTLQRCKRHASREEAELVQQMAANIKERQDVFFDMEAYLPKKNGLYLNLVLGNVNVTLLSNQAKFAYKDEYEKFKLYLTIILLLGAVACRFVLHYRVTDEVFNFLLVWYYCTLTIRESILISNGSRIKGWWVSHHYVSTFLSGVMLTWPNGPIYQKFRNQFLAFSIFQSCVQFLQYYYQRGCLYRLRALGERNHLDL

SEQ ID NO: 2468 - protein, 239 aa, Homo sapiens
MAALKSWLSRSVTSFFRYRQCLCVPVVANFKKRCFSELIRPWHKTVTIGFGVTLCAVPIAQKSEPHSLSSEALMRRAVSLVTDSTSTFLSQTTYALIEAITEYTKAVYTLTSLYRQYTSLLGKMNSEEEDEVWQVIIGARAEMTSKHQEYLKLETTWMTAVGLSEMAAEAAYQTGADQASITARNHIQLVKLQVEEVHQLSRKAETKLAEAQIEELRQKTQEEGEERAESEQEAYLRED

SEQ ID NO: 2469 - protein, 255 aa, Homo sapiens
MAAHLSYGRVNLNVLREAVRRELREFLDKCAGSKAIVWDEYLTGPFGLIAQYSLLKEHEVEKMFTLKGNRLPAADVKNIIFFVRPRLELMDIIAENVLSEDRRGPTRDFHILFVPRRSLLCEQRLKDLGVLGSFIHREEYSLDLIPFDGDLLSMESEGAFKECYLEGDQTSLYHAAKGLMTLQALYGTIPQIFGKGECARQVANMMIRMKREFTGSQNSIFPVFDNLLLLDRNVDLLTPLATQLTYEGLIDEIYG

SEQ ID NO: 2470 - protein, 255 aa, Homo sapiens
MSMLKPSGLKAPTKILKPGSTALKTPTAVVAPVEKTISSEKASSTPSSETQEEFVDDFRVGERVWVNGNKPGFIQFLGETQFAPGQWAGIVLDEPIGKNDGSVAGVRYFQCEPLKGIFTRPSKLTRKVQAEDEANGLQTTPASRATSPLCTSTASMVSSSPSTPSNIPQKPSQPAAKEPSATPPISNLTKTASESISNLSEAGSIKKGERELKIGDRVLVGGTKAGVVRFLGETDFAKGEWCGVELDEPLGKNDG

SEQ ID NO: 2471 - protein, 255 aa, Homo sapiens
MIIKEYRIPLPMTVEEYRIAQLYMIQKKSRNETYGEGSGVEILENRPYTDGPGGSGQYTHKVYHVGMHIPSWFRSILPKAALRVVEESWNAYPYTRTRFTCPFVEKFSIDIETFYKTDAGENPDVFNLSPVEKNQLTIDFIDIVKDPVPHNEYKTEEDPKLFQSTKTQRGPLSENWIEEYKKQVFPIMCAYKLCKVEFRYWGMQSKIERFIHDTGLRRVMVRAHRQAWCWQDEWYGLSMENIRELEKEAQLMLSR

SEQ ID NO: 2472 - protein, 255 aa, Homo sapiens
MDDKELIEYFKSQMKEDPDMASAVAAIRTLLEFLKRDKGETIQGLRANLTSAIETLCGVDSSVAVSSGGELFLRFISLASLEYSDYSKCKKIMIERGELFLRRISLSRNKIADLCHTFIKDGATILTHAYSRVVLRVLEAAVAAKKRFSVYVTESQPDLSGKKMAKALCHLNVPVTVVLDAAVGYIMEKADLVIVGAEGVVENGGIINKIGTNQMAVCAKAQNKPFYVVAESFKFVRLFPLNQQDVPDKFKYKAD

SEQ ID NO: 2473 - protein, 255 aa, Homo sapiens
MTSPHFSSYDEGPLDVSMAATNLENQLHSAQKNLLFLQREHASTLKGLHSEIRRLQQHCTDLTYELTVKSSEQTGDGTSKSSELKKRCEELEAQLKVKENENAELLKELEQKNAMITVLENTIKEREKKYLEELKAKSHKLTLLSSELEQRASTIAYLTSQLHAAKKKLMSSSGTSDASPSGSPVLASYKPAPPKDKLPETPRRRMKKSLSAPLHPEFEEVYRFGAESRKLLLREPVDAMPDPTPFLLARESAEV

SEQ ID NO: 2474 - protein, 255 aa, Homo sapiens
MSGSTQPVAQTWRATEPRYPPHSLSYPVQIARTHTDVGLLEYQHHSRDYASHLSPGSIIQPQRRRPSLLSEFQPGNERSQELHLRPESHSYLPELGKSEMEFIESKRPRLELLPDPLLRPSPLLATGQPAGSEDLTKDRSLTGKLEPVSPPSPPHTDPELELVPPRLSKEELIQNMDRVDREITMVEQQISKLKKKQQQLEEEAAKPPEPEKPVSPPPIESKHRSLVQIIYDENRKKAEAAHRILEGLGPQVELP

SEQ ID NO: 2475 - protein, 255 aa, Homo sapiens
MGKLRRRYNIKGRQQAGPGPSKGPPEPPPVQLELEDKDTLKGVDASNALVLPGKKKKKTKAPPLSKKEKKPLTKKEKKVLQKILEQKEKKSQRAEMLQKLSEVQASEAEMRLFYTTSKLGTGNRMYHTKEKADEVVAPGQEKISSLSGAHRKRRRWPSAEEEEEEEEESESELEEESELDEDPAAEPAEAGVGTTVAPLPPAPAPSSQPVPAGMTVPPPPAAAPPLPRALAKPAVFIPVNRSPEMQEERLKLPIL

SEQ ID NO: 2476 - protein, 255 aa, Homo sapiens
MALFYVARYPGPDAAAAAGPEGAEAGAHGRARALLERLQSRARERQQQREPAQTEAAASTEPATRRRRRPRRRRRVNDAEPGSPEAPQGKRRKADGEDAGAESNEEAPGEPSAGSSEEAPGEPSAGSSEEAPGERSTSASAEAAPDGPALEEAAGPLVPGLVLGGFGKRKAPKVQPFLPRWLAEPNCVRRNVTEDLVPIEDIPDVHPDLQKQLRAHGISSYFPVQAAVIPALLESAACGFLVGRGGYRPSDLCVS

SEQ ID NO: 2477 - protein, 255 aa, Homo sapiens
MSLRSGGRRRADPGADGEASRDDGATSSVSALKRLERSQWTDKMDLRFGFERLKEPGEKTGWLINMHPTEILDEDKRLGSAVDYYFIQDDGSRFKVALPYKPYFYIATRKGCEREVSSFLSKKFQGKIAKVETVPKEDLDLPNHLVGLKRNYIRLSFHTVEDLVKVRKEISPAVKKNREQDHASDAYTALLSSVLQRGGVITDEEETSKKIADQLDNIVDMREYDVPYHIRLSIDLKIHVAHWYNVRYRGNAFPV

SEQ ID NO: 2478 - protein, 255 aa, Homo sapiens
MDGASAEQDGLQEDRSHSGPSSLPEAPLKPPGPLVPPDQQDKVQCAEVNRASTEGESPDGPGQGGLCQNGPTPPFPDPPSSLDPTTSPVGPDASPGVAGFHDNLRKSQGTSAEGSVRKEALQSLRLSLPMQETQLCSTDSPLPLEKEEQVRLQARKWLEEQLKQYRVKRQQERSSQPATKTRLFSTLDPELMLNPENLPRASTLAMTKEYSFLRTSVPRGPKVGSLGLPAHPREKKTSKSSKIRSLADYRTEDSN

SEQ ID NO: 2479 - protein, 255 aa, Homo sapiens
MDTSSVGGLELTDQTPVLLGSTAMATSLTNVGNSFSGPANPLVSRSNKFQNSSVEDDDDVVFIEPVQPPPPSVPVVADQRTITFTSSKNEELQGNDSKITPSSKELASQKGSVSETIVIDDEEDMETNQGQEKNSSNFIERRPPETKNRTNDVDFSTSSFSRSKVNAGMGNSGITTEPDSEIQIANVTTLETGVSSVNDGQLENTDGRDMNLMITHVTSLQNTNLGDVSNGLQSSNFGVNIQTYTPSLTSQTKTG

SEQ ID NO: 2480 - protein, 255 aa, Homo sapiens
MTQAAVRPWAPCLENMTTAPNGLGPGPAAPCAGSDLKDAKMVTSLACGNGVCGCSPGGDTDTQEAKLSPAKLVRLFSTSRKRTGAHPERPHSMVLVGNSSTWNTLASFRKMGSFKKLKSSVLKGIQSREGSNACSKGEASEHGLGKSIPNGAVPGAQASRGSPLAPGPACGALRPAEWGTLDGSDLEDTDDAFQRSTHRSRSLRRAYGLGRICLLDAPQNHATPTIATGQVPAVCEILVRDPENNSMGYRRSKST

SEQ ID NO: 2481 - protein, 255 aa, Homo sapiens
MSTGFSFGSGTLGSTTVAAGGTSTGGVFSFGTGASSNPSVGLNFGNLGSTSTPATTSAPSSGFGTGLFGSKPATGFTLGGTNTGIATTITTGLTLGTPATTSAATTGFSLGFNKPAASATPFALPITSTSASGLTLSSALTSTPAASTGFTLNNLGGTTATTTTASTGLSLGGALAGLGGSLFQSTNTGTSGLGQNALGLTLGTTAATSTAGNEGLGGIDFSSSSDKKSDKTGTRPEDSKALKDENLPPVICQDV

SEQ ID NO: 2482 - protein, 255 aa, Homo sapiens
MNSGGGLPPPSAAASPSSSSLAAAVAVVAPPGVGGVPGGAAVGVKLKYCRYYAKDKTCFYGEECQFLHEDPAAGAAPGLGLHSNSVPLALAGAPVAGFPPGAVAGGGAGPPPGPKKPDLGDPGTGAAAGGGGSSGGLDGPRLAIPGMDGGALTDTSLTDSYFSTSFIGVNGFGSPVETKYPLMQRMTNSSSSPSLLNDSAKPYSAHDPLTSPASSLFNDFGALNISQRRKPRKYRLGMLEERLVPMGSKARKAKN

SEQ ID NO: 2483 - protein, 218 aa, Homo sapiens
MLTFNHDAPWHTQKTLKTSEFGKSFGTLGHIGNISHQCWAGCAAGGRAVLSGEPEANMDQETVGNVVLLAIVTLISVVQNGFFAHKVEHESRTQNGRSFQRTGTLAFERVYTANQNCVDAYPTFLAVLWSAGLLCSQVPAAFAGLMYLFVRQKYFVGYLGERTQSTPGYIFGKRIILFLFLMSVAGIFNYYLIFFFGSDFENYIKTISTTISPLLLIP

SEQ ID NO: 2484 - protein, 133 aa, Homo sapiens
MATNFLVGEKIWFHKFKYGDAERRFYEQMNGPVAGASLQEASMILHDIARARENIPKSLAGSLGPGASSGPSGDHSELVVRIASLEVDNQRDLAERAGEELARPLGHSPADPAHVSHAPSGAPGQEASHTSRG

SEQ ID NO: 2485 - protein, 255 aa, Homo sapiens
MPASAPPRRPRPPPPSLSLLLVLLGLGGRRLRAEPGDGAQTWARFSRPPAPEAAGLFQGTFPDGFLWAVGSAAYQTEGGWQQHGKGASIWDTFTHHPLAPPGDSRNASLPLGAPSPLQPATGDVASDSYNNVFRDTEALRELGVTHYRFSISWARVLPNGSAGVPNREGLRYYRRLLERLRELGVQPVVTLYHWDLPQRLQDAYGGWANRALADHFRDYAELCFRHFGGQVKYWITIDNPYVVAWHGYATGRLAP

SEQ ID NO: 2486 - protein, 85 aa, Homo sapiens
MSKVSFKITLTSDPRLPYKVLSVPESTPFTAVLKFAAEEFKVPAATSAIITNDGIGINPAQTAGNVFLKHGSELRIIPRDRVGSC

SEQ ID NO: 2487 - protein, 255 aa, Homo sapiens
MPNVLLPPKESNLFKRILKCYEQKQYKNGLKFCKMILSNPKFAEHGETLAMKGLTLNCLGKKEEAYEFVRKGLRNDVKSHVCWHVYGLLQRSDKKYDEAIKCYRNALKLDKDNLQILRDLSLLQIQMRDLEGYRETRYQLLQLRPTQRASWIGYAIAYHLLKDYDMALKLLEEFRQTQQVPPNKIDYEYSELILYQNQVMREADLLQESLEHIEMYEKQICDKLLVEEIKGEILLKLGRLKEASEVFKNLIDRNA

SEQ ID NO: 2488 - protein, 255 aa, Homo sapiens
MVKVTFNSALAQKEAKKDEPKSGEEALIIPPDAVAVDCKDPDDVVPVGQRRAWCWCMCFGLAFMLAGVILGGAYLYKYFALQPDDVYYCGIKYIKDDVILNEPSADAPAALYQTIEENIKIFEEEEVEFISVPVPEFADSDPANIVHDFNKKLTAYLDLNLDKCYVIPLNTSIVMPPRNLLELLINIKAGTYLPQSYLIHEHMVITDRIENIDHLGFFIYRLCHDKETYKLQRRETIKGIQKREASNCFAIRHFE

SEQ ID NO: 2489 - protein, 255 aa, Homo sapiens
MAEHPPLLDTTQILSSDISLLSAPIVSADGTQQVILVQVNPGEAFTIRREDGQFQCITGPAQVPMMSPNGSVPPIYVPPGYAPQVIEDNGVRRVVVVPQAPEFHPGSHTVLHRSPHPPLPGFIPVPTMMPPPPRHMYSPVTGAGDMTTQYMPQYQSSQVYGDVDAHSTHGRSNFRDERSSKTYERLQKKLKDRQGTQKDKMSSPPSSPQKCPSPINEHNGLIKGQIAGGINTGSAKIKSGKGKGGTQVDTEIEEK

SEQ ID NO: 2490 - protein, 255 aa, Homo sapiens
MKEAGQMQNLESARAGRSVSTQTGSMTGQIPRLSKVNLFTLLSLWMELFPAEAQRQKSQKNEEGKHGPLGDNEERTRVSTDKRQVKRTGLVVVKNMKIVGLHCSSEDLHAGQIALIKHGSRLKNCDLYFSRKPCSACLKMIVNAGVNRISYWPADPEISLLTEASSSEDAKLDAKAVERLKSNSRAHVCVLLQPLVCYMVQFVEETSYKCDFIQKITKTLPDANTDFYYECKQERIKEYEMLFLVSNEEMHKQIL

SEQ ID NO: 2491 - protein, 196 aa, Homo sapiens
MGSVNSRGHKAEAQVVMMGLDSAGKTTLLYKLKGHQLVETLPTVGFNVEPLKAPGHVSLTLWDVGGQAPLRASWKDYLEGTDILVYVLDSTDEARLPESAAELTEVLNDPNMAGVPFLVLANKQEAPDALPLLKIRNRLSLERFQDHCWELRGCSALTGEGLPEALQSLWSLLKSRSCMCLQARAHGAERGDSKRS

SEQ ID NO: 2492 - protein, 255 aa, Homo sapiens
MQDYNKDDMSYRRISAVEPKTALPFNRFLPNKSRQPSYVPAPLRKKKPDKHEDNRRSWASPVYTEADGTFSSNQRRIWGTNVENWPTVQGTSKSSCYLEEEKAKTRSIPNIVKDDLYVRKLSPVMPNPGNAFDQFLPKCWTPEDVNWKRIKRETYKPWYKEFQGFSQFLLLQALQTYSDDILSSETHTKIDPTSGPRLITRRKNLSYAPGYRRDDLEMAALDPDLENDDFFVRKTGAFHANPYVLRAFEDFRKFS

SEQ ID NO: 2493 - protein, 255 aa, Homo sapiens
MVAPGSVTSRLGSVFPFLLVLVDLQYEGAECGVNADVEKHLELGKKLLAAGQLADALSQFHAAVDGDPDNYIAYYRRATVFLAMGKSKAALPDLTKVIQLKMDFTAARLQRGHLLLKQGKLDEAEDDFKKVLKSNPSENEEKEAQSQLIKSDEMQRLRSQALNAFGSGDYTAAIAFLDKILEVCVWDAELRELRAECFIKEGEPRKAISDLKAASKLKNDNTEAFYKISTLYYQLGDHELSLSEVRECLKLDQDH

SEQ ID NO: 2494 - protein, 255 aa, Homo sapiens
MSARLPVLSPPRWPRLLLLSLLLLGAVPGPRRSGAFYLPGLAPVNFCDEEKKSDECKAEIELFVNRLDSVESVLPYEYTAFDFCQASEGKRPSENLGQVLFGERIEPSPYKFTFNKKETCKLVCTKTYHTEKAEDKQKLEFLKKSMLLNYQHHWIVDNMPVTWCYDVEDGQRFCNPGFPIGCYITDKGHAKDACVISSDFHERDTFYIFNHVDIKIYYHVVETGSMGARLVAAKLEPKSFKHTHIDKPDCSGPPM

SEQ ID NO: 2495 - protein, 255 aa, Homo sapiens
MALRLLRRAARGAAAAALLRLKASLAADIPRLGYSSSSHHKYIPRRAVLYVPGNDEKKIKKIPSLNVDCAVLDCEDGVAANKKNEARLRIVKTLEDIDLGPTEKCVRVNSVSSGLAEEDLETLLQSRVLPSSLMLPKVESPEEIQWFADKFSFHLKGRKLEQPMNLIPFVETAMGLLNFKAVCEETLKVGPQVGLFLDAVVFGGEDFRASIGATSSKETLDILYARQKIVVIAKAFGLQAIDLVYIDFRDGAGLL

SEQ ID NO: 2496 - protein, 255 aa, Homo sapiens
MAGFWVGTAPLVAAGRRGRWPPQQLMLSAALRTLKHVLYYSRQCLMVSRNLGSVGYDPNEKTFDKILVANRGEIACRVIRTCKKMGIKTVAIHSDVDASSVHVKMADEAVCVGPAPTSKSYLNMDAIMEAIKKTRAQAVHPGYGFLSENKEFARCLAAEDVVFIGPDTHAIQAMGDKIESKLLAKKAEVNTIPGFDGVVKDAEEAVRIAREIGYPVMIKASAGGGGKGMRIAWDDEETRDGFRLSSQEAASSFGD

SEQ ID NO: 2497 - protein, 255 aa, Homo sapiens
MAASQTSQTVASHVPFADLCSTLERIQKSKGRAEKIRHFREFLDSWRKFHDALHKNHKDVTDSFYPAMRLILPQLERERMAYGIKETMLAKLYIELLNLPRDGKDALKLLNYRTPTGTHGDAGDFAMIAYFVLKPRCLQKGSLTIQQVNDLLDSIASNNSAKRKDLIKKSLLQLITQSSALEQKWLIRMIIKDLKLGVSQQTIFSVFHNDAAELHNVTTDLEKVCRQLHDPSVGLSDISITLFSAFKPMLAAIAD

SEQ ID NO: 2498 - protein, 255 aa, Homo sapiens
MAAPGSARRPLLLLLLLLLLGLMHCASAAMFMVKNGNGTACIMANFSAAFSVNYDTKSGPKNMTFDLPSDATVVLNRSSCGKENTSDPSLVIAFGRGHTLTLNFTRNATRYSVQLMSFVYNLSDTHLFPNASSKEIKTVESITDIRADIDKKYRCVSGTQVHMNNVTVTLHDATIQAYLSNSSFSRGETRCEQDRPSPTTAPPAPPSPSPSPVPKSPSVDKYNVSGTNGTCLLASMGLQLNLTYERKDNTTVTRL

SEQ ID NO: 2499 - protein, 255 aa, Homo sapiens
MKVLGRSFFWVLFPVLPWAVQAVEHEEVAQRVIKLHRGRGVAAMQSRQWVRDSCRKLSGLLRQKNAVLNKLKTAIGAVEKDVGLSDEEKLFQVHTFEIFQKELNESENSVFQAVYGLQRALQGDYKDVVNMKESSRQRLEALREAAIKEETEYMELLAAEKHQVEALKNMQHQNQSLSMLDEILEDVRKAADRLEEEIEEHAFDDNKSVKGVNFEAVLRVEEEEANSKQNITKREVEDDLGLSMLIDSQNNQYIL

SEQ ID NO: 2500 - protein, 255 aa, Homo sapiens
MRSEKEGAGGLRAAVAARGPSGREKLSALEVQFHRDSQQQEAETPPTSSSGCGGGAGKPREEKRTALSKVVIRRLPPGLTKEQLEEQLRPLPAHDYFEFFAADLSLYPHLYSRAYINFRNPDDILLFRDRFDGYIFLDSKGLEYPAVVEFAPFQKIAKKKLRKKDAKTGSIEDDPEYKKFLETYCVEEEKTSANPETLLGEMEAKTRELIARRTTPLLEYIKNRKLEKQRIREEKREERRRRELEKKRLREEEKR

SEQ ID NO: 2501 - protein, 255 aa, Homo sapiens
MEKCSVGGLELTEQTPALLGNMAMATSLMDIGDSFGHPACPLVSRSRNSPVEDDDDDDDVVFIESIQPPSISAPAIADQRNFIFASSKNEKPQGNYSVIPPSSRDLASQKGNISETIVIDDEEDIETNGGAEKKSSCFIEWGLPGTKNKTNDLDFSTSSLSRSKTKTGVRPFNPGRMNVAGDLFQNGEFATHHSPDSWISQSASFPSNQKQPGVDSLSPVALLRKQNFQPTAQQQLTKPAKITCANCKKPLQKGQ

SEQ ID NO: 2502 - protein, 255 aa, Homo sapiens
MAPWTLWRCCQRVVGWVPVLFITFVVVWSYYAYVVELCVFTIFGNEENGKTVVYLVAFHLFFVMFVWSYWMTIFTSPASPSKEFYLSNSEKERYEKEFSQERQQEILRRAARALPIYTTSASKTIRYCEKCQLIKPDRAHHCSACDSCILKMDHHCPWVNNCVGFSNYKFFLLFLLYSLLYCLFVAATVLEYFIKFWTNELTDTRAKFHVLFLFFVSAMFFISVLSLFSYHCWLVGKNRTTIESFRAPTFSYGPD

SEQ ID NO: 2503 - protein, 255 aa, Homo sapiens
MVMGIFANCIFCLKVKYLPQQQKKKLQTDIKENGGKFSFSLNPQCTHIILDNADVLSQYQLNSIQKNHVHIANPDFIWKSIREKRLLDVKNYDPYKPLDITPPPDQKASSSEVKTEGLCPDSATEEEDTVELTEFGMQNVEIPHLPQDFEVAKYNTLEKVGMEGGQEAVVVELQCSRDSRDCPFLISSHFLLDDGMETRRQFAIKKTSEDASEYFENYIEELKKQGFLLREHFTPEATQLASEQLQALLLEEVMN

SEQ ID NO: 2504 - protein, 255 aa, Homo sapiens
MSTGFSFGSGTLGSTTVAAGGTSTGGVFSFGTGASSNPSVGLNFGNLGSTSTPATTSAPSSGFGTGLFGSKPATGFTLGGTNTGTPATTSAATTGFSLGFNKPAASATPFALPITSTSASGLTLSSALTSTPAASTGFTLNNLGGTTATTTTASTGLSLGGALAGLGGSLFQSTNTGTSGLGQNALGLTLGTTAATSTAGNEGLGGIDFSSSSDKKSDKTGTRPEDSKALKDENLPPVICQDVENLQKFVKEQKQ

SEQ ID NO: 2505 - protein, 255 aa, Homo sapiens
MSVVGLDVGSQSCYIAVARAGGIETIANEFSDRCTPSVISFGSKNRTIGVAAKNQQITHANNTVSNFKRFHGRAFNDPFIQKEKENLSYDLVPLKNGGVGIKVMYMGEEHLFSVEQITAMLLTKLKETAENSLKKPVTDCVISVPSFFTDAERRSVLDAAQIVGLNCLRLMNDMTAVALNYGIYKQDLPSLDEKPRIVVFVDMGHSAFQVSACAFNKGKLKVLGTAFDPFLGGKNFDEKLVEHFCAEFKTKYKLD

SEQ ID NO: 2506 - protein, 229 aa, Homo sapiens
ILIPWVGTDDYFHHQDGYRYNVNQLGDAHDWNQNRAKQAIDQGRSPVIIDNTNIQAWEMKPYVEVAIGKGYRVEFHEPETWWKFDPEELEKRNKHGVSRKKIAQMLDRYEYQMSISIVMNSVEPSHKSTQRPPPPQGRQRFDRKLKRWEEPKELPAEDSQDLTSTDYRSLELPLSQGFAFQLVKLFGSPGVPMESLLPDDYVVPLDWKTLKMIYLQWKMSVEKRQKKIG

SEQ ID NO: 2507 - protein, 255 aa, Homo sapiens
MAAVVQQNDLVFEFASNVMEDERQLGDPAIFPAVIVEHVPGADILNSYAGLACVEEPNDMITESSLDVAEEEIIDDDDDDITLTVEASCHDGDETIETIEAAEALLNMDSPGPMLDEKRINNNIFSSPEDDMVVAPVTHVSVTLDGIPEVMETQQVQEKYADSPGASSPEQPKRKKGRKTKPPRPDSPATTPNISVKKKNKDGKGNTIYLWEFLLALLQDKATCPKYIKWTQREKGIFKLVDSKAVSRLWGKHKN

SEQ ID NO: 2508 - protein, 255 aa, Homo sapiens
MARGSVSDEEMMELREAFAKVDTDGNGYISFNELNDLFKAACLPLPGYRVREITENLMATGDLDQDGRISFDEFIKIFHGLKSTDVAKTFRKAINKKEGICAIGGTSEQSSVGTQHSYSEEEKYAFVNWINKALENDPDCRHVIPMNPNTNDLFNAVGDGIVLCKMINLSVPDTIDERTINKKKLTPFTIQENLNLALNSASAIGCHVVNIGAEDLKEGKPYLVLGLLWQVIKIGLFADIELSRNEALIALLREG

SEQ ID NO: 2509 - protein, 255 aa, Homo sapiens
MAENPSLENHRIKSFKNKGRDVETMRRHRNEVTVELRKNKRDEHLLKKRNVPQEESLEDSDVDADFKAQNVTLEAILQNATSDNPVVQLSAVQAARKLLSSDRNPPIDDLIKSGILPILVKCLERDDNPSLQFEAAWALTNIASGTSAQTQAVVQSNAVPLFLRLLRSPHQNVCEQAVWALGNIIGDGPQCRDYVISLGVVKPLLSFISPSIPITFLRNVTWVIVNLCRNKDPPPPMETVQEILPALCVLIYHTD

SEQ ID NO: 2510 - protein, 157 aa, Homo sapiens
MATSVLCCLRCCRDGGTGHIPLKEMPAVQLDTQHMGIWGIGVATQKVNLNQIPLGRDMHSLVMRNDGALYHNNEEKNRLPANSLPQEGDVVGITYDHVELNVYLNGKNMHCPASGIRGTVYPVVYDDDSAILDCQFSEFYHTPPPGFEKILFEQQIF

SEQ ID NO: 2511 - protein, 55 aa, Homo sapiens
MKMSFERCTARNKMFVNSPFTKVDNYCTFLMEKVLFKVLFLIEYYQKGKKNDLNF

SEQ ID NO: 2512 - protein, 617 aa, Homo sapiens
MSGYDRMLRTLGGNLMEFIENLDALHSYLALSYQEMNAPSFRVERGADGKMFLHYYSDRSGLCHIVPGIIEAVAKDFFDIDVIMDILDMNEEVERTGKKEHVVFLIVQKAHRKMRKTKPKRLQDSQGMERDQEALQAAFLKMKEKYLNVSACPVKKSHWDVVRSIVMFGKGHLMNTFEPIYPERLWIEEKTFCNAFPFHIVFDESLQVKQARVNIQKYVPGLQTQNIQLDEYFSIIHPQVTFNIFSIRRFINSQFVLKTRREMMPVAWQSRTTLKLQGQMIWMESMWCMVYLCSPKLRSLQELEELNMHLSDIAPNDTTRDLILLNQQRLAEIELSNQLERKKEELQVLSKHLAIEKKKTETLLYAMLPKHVANQLREGKKVAAGEFKSCTILFSDVVTFTNICTACEPIQIVNVLNSMYSKFDRLTSVHAVYKVETIGDAYMVVGGVPVPIGNHAQRVANFALGMRISAKEVTNPVTGEPIQLRVGIHTGPVLADVVGDKMPRYCLFGDTVNTASRMESHGLPNKVHLSPTAYRALKNQGFKIIERGEIEVKGKGRMTTYFLIQNLNATEDEIMGRSKTPVDHKGSTQKASLPTTKLQGSVQPSCPEHSSLASWLL

SEQ ID NO: 2513 - protein, 255 aa, Homo sapiens
MPILLFLIDTSASMNQRSHLGTTYLDTAKGAVETFMKLRARDPASRGDRYMLVTFEEPPYAIKAGWKENHATFMNELKNLQAEGLTTLGQSLRTAFDLLNLNRLVTGIDNYGQGRNPFFLEPAIIITITDGSKLTTTSGVQDELHLPLNSPLPGSELTKEPFRWDQRLFALVLRLPGTMSVESEQLTGVPLDDSAITPMCEVTGGRSYSVCSPRMLNQCLESLVQKVQSGVVINFEKAGPDPSPVEDGQPDISRP

SEQ ID NO: 2514 - protein, 760 aa, Homo sapiens
MAVPAALIPPTQLVPPQPPISTSASSSGTTTSTSSATSSPAPSIGPPASSGPTLFRPEPIASAAAAAATVTSTGGGGGGGGGGSGGGGGSSGNGGGGGGGGGGSNCNPNLAAASNGSGGGGGGISAGGGVASSTPINASTGSSSSSSSSSSSSSSSSSSSSSSSSCGPLPGKPVYSTPSPVENTPQNNECKMVDLRGAKVASFTVEGCELICLPQAFDLFLKHLVGGLHTVYTKLKRLEITPVVCNVEQVRILRGLGAIQPGVNRCKLISRKDFETLYNDCTNASSRPGRPPKRTQSVTSPENSHIMPHSVPGLMSPGIIPPTGLTAAAAAAAAATNAAIAEAMKVKKIKLEAMSNYHASNNQHGADSENGDMNSSVGSSDGSWDKETLPSSPSQGPQASITHPRMPGARSLPLSHPLNHLQQSHLLPNGLELPFMMMPHPLIPVSLPPASVTMAMSQMNHLSTIANMAAAAQVQSPPSRVETSVIKERVPDSPSPAPSLEEGRRPGSHPSSHRSSSVSSSPARTESSSDRIPVHQNGLSMNQMLMGLSPNVLPGPKEGDLAGHDMGHESKRMHIEKDETPLSTPTARDSLDKLSLTGHGQPLPPGFPSPFLFPDGLSSIETLLTNIQGLLKVAIDNARAQEKQVQLEKTELKMDFLRERELRETLEKQLAMEQKNRAIVQKRLKKEKKAKRKLQEALEFETKRREQAEQTLKQAASTDSLRVLNDSLTPEIEADRSGGRTDAERTIQDGRLYLKTTVMY

SEQ ID NO: 2515 - protein, 255 aa, Homo sapiens
MEPPSCIQDEPFPHPLEPEPGVSAQPGPGKPSDKRFRLWYVGGSCLDHRTTLPMLPWLMAEIRRRSQKPEAGGCGAPAAREVILVLSAPFLRCVPAPGAGASGGTSPSATQPNPAVFIFEHKAQHISRFIHNSHDLTYFAYLIKAQPDDPESQMACHVFRATDPSQVPDVISSIRQLSKAAMKEDAKPSKDNEDAFYNSQKFEVLYCGKVTVTHKKAPSSLIDDCMEKFSLHEQQRLKIQGEQRGPDPGEDLADL

SEQ ID NO: 2516 - protein, 255 aa, Homo sapiens
MNKSTCLMAAETPSKRWRLHCLAFSQRFVRAGPACSSREACSSPRAGWNPAGFRLPGRWSPFVALHLVCQIREALKLRSGHRTPSGAGSSMQPPPSLCGRALVALVLACGLSRIWGEERGFPPDRATPLLQTAEIMTPPTKTLWPKGSNASLARSLAPAEVPKGDRTAGSPPRTISPPPCQGPIEIKETFKYINTVVSCLVFVLGIIGNSTLLRIIYKNKCMRNGPNILIASLALGDLLHIVIDIPINVYKLLAE

SEQ ID NO: 2517 - protein, 255 aa, Homo sapiens
MAPAKATNVVRLLLGSTALWLSQLGSGTVAASKSVTAHLAAKWPETPLLLEASEFMAEESNEKFWQFLETVQELAIYKQTESDYSYYNLILKKAGQFLDNLHINLLKFAFSIRAYSPAIQMFQQIAADEPPPDGCNAFVVIHKKHTCKINEIKKLLKKAASRTRPYLFKGDHKFPTNKENLPVVILYAEMGTRTFSAFHKVLSEKAQNEEILYVLRHYIQKPSSRKMYLSGYGVELAIKSTEYKALDDTQVKTVT

SEQ ID NO: 2518 - protein, 255 aa, Homo sapiens
MDIQMANNFTPPSATPQGNDCDLYAHHSTARIVMPLHYSLVFIIGLVGNLLALVVIVQNRKKINSTTLYSTNLVISDILFTTALPTRIAYYAMGFDWRIGDALCRITALVFYINTYAGVNFMTCLSIDRFIAVVHPLRYNKIKRIEHAKGVCIFVWILVFAQTLPLLINPMSKQEAERITCMEYPNFEETKSLPWILLGACFIGYVLPLIIILICYSQICCKLFRTAKQNPLTEKSGVNKKALNTIILIIVVFVL

SEQ ID NO: 2519 - protein, 255 aa, Homo sapiens; identical to SEQ ID NO: 2497

SEQ ID NO: 2520 - protein, 255 aa, Homo sapiens
MSAAGAGAGVEAGFSSEELLSLRFPLHRACRDGDLATLCSLLQQTPHAHLASEDSFYGWTPVHWAAHFGKLECLVQLVRAGATLNVSTTRYAQTPAHIAAFGGHPQCLVWLIQAGANINKPDCEGETPIHKAARSGSLECISALVANGAHVDLRNASGLTAADIAQTQGFQECAQFLLNLQNCHLNHFYNNGILNGGHQNVFPNHISVGTNRKRCLEDSEDFGVKKARTEAQSLDSAVPLTNGDTEDDADKMHVD

SEQ ID NO: 2521 - protein, 255 aa, Homo sapiens
MAVEDEGLRVFQSVKIKIGEAKNLPSYPGPSKMRDCYCTVNLDQEEVFRTKIVEKSLCPFYGEDFYCEIPRSFRHLSFYIFDRDVFRRDSIIGKVAIQKEDLQKYHNRDTWFQLQHVDADSEVQGKVHLELRLSEVITDTGVVCHKLATRIVECQGLPIVNGQCDPYATVTLAGPFRSEAKKTKVKRKTNNPQFDEVFYFEVTRPCSYSKKSHFDFEEEDVDKLEIRVDLWNASNLKFGDEFLGELRIPLKVLRQ

SEQ ID NO: 2522 - protein, 161 aa, Homo sapiens
MVPKLFTSQICLLLLLGLLAVEGSLHVKPPQFTWAQWFETQHINMTSQQCTNAMQVINNYQRRCKNQNTFLLTTFANVVNVCGNPNMTCPSNKTRKNCHHSGSQVPLIHCNLTTPSPQNISNCRYAQTPANMFYIVACDNRDQRRDPPQYPVVPVHLDRII

SEQ ID NO: 2523 - protein, 255 aa, Homo sapiens
MSHLVDPTSGDLPVRDIDAIPLVLPASKGKNMKTQPPLSRMNREELEDSFFRLREDHMLVKELSWKQQDEIKRLRTTLLRLTAAGRDLRVAEEAAPLSETARRGQKAGWRQRLSMHQRPQMHRLQGHFHCVGPASPRRAQPRVQVGHRQLHTAGAPVPEKPKRGPRDRLSYTAPPSFKEHATNENRGEVASKPSELVSGSNSIISFSSVISMAKPIGLCMPNSAHIMASNTMQVEEPPKSPEKMWPKDENFEQRS

SEQ ID NO: 2524 - protein, 255 aa, Homo sapiens
MASGRARCTRKLRNWVVEQVESGQFPGVCWDDTAKTMFRIPWKHAGKQDFREDQDAAFFKAWAIFKGKYKEGDTGGPAVWKTRLRCALNKSSEFKEVPERGRMDVAEPYKVYQLLPPGIVSGQPGTQKVPSKRQHSSVSSERKEEEDAMQNCTLSPSVLQDSLNNEEEGASGGAVHSDIGSSSSSSSPEPQEVTDTTEAPFQGDQRSLEFLLPPEPDYSLLLTFIYNGRVVGEAQVQSLDCRLVAEPSGSESSME

SEQ ID NO: 2525 - protein, 255 aa, Homo sapiens
MGKGDVLEAAPTTTAYHSLMDEYGYEVGKAIGHGSYGSVYEAFYTKQKVMVAVKIISKKKASDDYLNKFLPREIQVMKVLRHKYLINFYRAIESTSRVYIILELAQGGDVLEWIQRYGACSEPLAGKWFSQLTLGIAYLHSKSIVHRLMPSLSAAGRDLKLENLLLDKWENVKISDFGFAKMVPSNQPVGCSPSYRQVNCFSHLSQTYCGSFAYACPEILRGLPYNPFLSDTWSMGVILYTLVVAHLPFDDTNLK

SEQ ID NO: 2526 - protein, 255 aa, Homo sapiens
MGQGPRSPHKVGRRFPAGGKRGRGAKGSGRPLPGRKRQPWPPPDGRSEPAPDSHPHLSPEALGYFRRALSALKEAPETGEERDLMVHNIMKEVETQALALSTNRTGSEMLQELLGFSPLKPLCRVWAALRSNLRTVACHRCGVHVLQSALLQLPRLLGSAAEEEEEEEEDGKDGPTETLEELVLGLAAEVCDDFLVYCGDTHGSFVVRTLLQVLGGTILESERARPRGSQSSEAQKTPAQECKPADFEVPETFLN

SEQ ID NO: 2527 - protein, 255 aa, Homo sapiens
MAAAAAATAAAAASIRERQTVALKRMLNFNVPHIKNSTGEPVWKVLIYDRFGQDIISPLLSVKELRDMGITLHLLLHSDRDPIPDVPAVYFVMPTEENIDRMCQDLRNQLYESYYLNFISAISRSKLEDIANAALAASAVTQVAKVFDQYLNFITLEDDMFVLCNQNKELVSYRAINRPDITDTEMETVMDTIVDSLFCFFVTLGAVPIIRCSRGTAAEMVAVKLDKKLRENLRDARNSLFTGDTLGAGQFSFQR

SEQ ID NO: 2528 - protein, 255 aa, Homo sapiens
MSGRQRTLFQTWGSSISRSSGTPGCSSGTERPQSPGSSKAPLPAAAEAQLESDDDVLLVAAYEAERQLCLENGGFCTSAGALWIYPTNCPVRDYQLHISRAALFCNTLVCLPTGLGKTFIAAVVMYNFYRWFPSGKVVFMAPTKPLVTQQIEACYQVMGIPQSHMAEMTGSTQASTRKEIWCSKRVLFLTPQVMVNDLSRGACPAAEIKCLVIDEAHKALGNYAYCQVVRELVKYTNHFRILALSATPGSDIKAV

SEQ ID NO: 2529 - protein, 255 aa, Homo sapiens
MDAQDCQAAASPEPPGPPARSCVAAWWDMVDRNLRYFPHSCSMLGRKIAALYDSFTSKSLKEHVFLPLIDMLIYFNFFKAPFLVDLKKPELKIPHTVNFYLRVEPGVMLGIWHTVPSCRGEDAKGKDCCWYEAALRDGNPIIVYLHGSAEHRAASHRLKLVKVLSDGGFHVLSVDYRGFGDSTGKPTEEGLTTDAICVYEWTKARSGITPVCLWGHSLGTGVATNAAKVLEEKGCPVDAIVLEAPFTNMWVASIN

SEQ ID NO: 2530 - protein, 255 aa, Homo sapiens
MKSPFYRCQNTTSVEKGNSAVMGGVLFSTGLLGNLLALGLLARSGLGWCSRRPLRPLPSVFYMLVCGLTVTDLLGKCLLSPVVLAAYAQNRSLRVLAPALDNSLCQAFAFFMSFFGLSSTLQLLAMALECWLSLGHPFFYRRHITLRLGALVAPVVSAFSLAFCALPFMGFGKFVQYCPGTWCFIQMVHEEGSLSVLGYSVLYSSLMALLVLATVLCNLGAMRNLYAMHRRLQRHPRSCTRDCAEPRADGREASP

SEQ ID NO: 2531 - protein, 255 aa, Homo sapiens
MHLKPYWKLQKKEHPPEVSRETQRTPMNHQKAVNDETCKASHITSSVFPSASLGKASSRKPFGILSPNVLCSMSGKSPVESSLNVKTKKNAPSATIHQGEEEGPLDIWAVVKPGNTKEKIAFFASHQCSNRIGSMKIKSSWDIDGRATKRRKKSGDLKKAKVQVERMREVNSRCYQPEPFACGIEHCSVHYVSDSGDGVYAGRPLSVIQMVAFLEQRASALLASCSKNCTNSPAIVRFSGQSRGVPAVSESYSAP

SEQ ID NO: 2532 - protein, 255 aa, Homo sapiens
MSPHGDGRGQAQGRAVRVGLRRSGGIRGGVAVFAAVAAVFTFTLPPSVPGGDSGELITAAHELGVAHPPGYPLFTLVAKLAITLFPFGSIAYRVNLLCGLFGAVAASLLFFTVFRLSGSSAGGILAAGVFSFSRLTWQWSIAAEVFSLNNLFVGLLMALTVHFEEAATAKERSKVAKIGAFCCGLSLCNQHTIILYVLCIIPWILFQLLKKKELSLGSLLKLSLYFSAGLLPYVHLPISSYLNHARWTWGDQTTL

SEQ ID NO: 2533 - protein, 255 aa, Homo sapiens
MPLYEGLGSGGEKTAVVIDLGEAFTKCGFAGETGPRCIIPSVIKRAGMPKPVRVVQYNINTEELYSYLKEFIHILYFRHLLVNPRDRRVVIIESVLCPSHFRETLTRVLFKYFEVPSVLLAPSHLMALLTLGINSAMVLDCGYRESLVLPIYEGIPVLNCWGALPLGGKALHKELETQLLEQCTVDTSVAKEQSLPSVMGSVPEGVLEDIKARTCFVSDLKRGLKIQAAKFNIDGNNERPSPPPNVDYPLDGEKI

SEQ ID NO: 2534 - protein, 255 aa, Homo sapiens
MKAADEPAYLTVGTDVSAKYRGAFCEAKIKTVKRLVKVKVLLKQDNTTQLVQDDQVKGPLRVGAIVETRTSDGSFQEAIISKLTDASWYTVVFDDGDERTLRRTSLCLKGERHFAESETLDQLPLTNPEHFGTPVIAKKTNRGRRSSLPVTEDEKEEESSEEEDEDKRRLNDELLGKVVSVVSATERTEWYPALVISPSCNDDITVKKDQCLVRSFIDSKFYSIARKDIKEVDILNLPESELSTKPGLQKASIFL

SEQ ID NO: 2535 - protein, 255 aa, Homo sapiens
MAVDIQPACLGLYCGKTLLFKNGSTEIYGECGVCPRGQRTNAQKYCQPCTESPELYDWLYLGFMAMLPLVLHWFFIEWYSGKKSSSALFQHITALFECSMAAIITLLVSDPVGVLYIRSCRVLMLSDWYTMLYNPSPDYVTTVHCTHEAVYPLYTIVFIYYAFCLVLMMLLRPLLVKKIACGLGKSDRFKSIYAALYFFPILTVLQAVGGGLLYYAFPYIILVLSLVTLAVYMSASEIENCYDLLVRKKRLIVLF

SEQ ID NO: 2536 - protein, 255 aa, Homo sapiens
MEGAGGANDKKKISSERRKEKSRDAARSRRSKESEVFYELAHQLPLPHNVSSHLDKASVMRLTISYLRVRKLLDAGDLDIEDDMKAQMNCFYLKALDGFVMVLTDDGDMIYISDNVNKYMGLTQFELTGHSVFDFTHPCDHEEMREMLTHRNGLVKKGKEQNTQRSFFLRMKCTLTSRGRTMNIKSATWKVLHCTGHIHVYDTNSNQPQCGYKKPPMTCLVLICEPIPHPSNIEIPLDSKTFLSRHSLDMKFSYC

SEQ ID NO: 2537 - protein, 255 aa, Homo sapiens
MASSPELPTEDEQGSWGIDDLHISLQAEQEDTQKKAFTCWINSQLARHTSPSVISDLFTDIKKGHVLLDLLEVLSGQQLPRDKGSNTFQCRINIEHALTFLRNRSIKLINIHVTDIIDGNPSIILGLIWTIILHFHIEKLAQTLSCNYNQPSLDDVSVVDSSPASSPPAKKCSKVQARWQMSARKALLLWAQEQCATYESVNVTDFKSSWRNGMAFLAIIHALRPDLIDMKSVKHRSNKDNLREAFRIAEQELKI

SEQ ID NO: 2538 - protein, 621 aa, Homo sapiens
MSRQNLVALTVTTLLGVAVGGFVLWKGIQRRRRSKTSPVTQQPQQKVLGSRELPPPEDDQLHSSAPRSSWKERILKAKVVTVSQEAEWDQIEPLLRSELEDFPVLGIDCEWVNLEGKASPLSLLQMASPSGLCVLVRLPKLICGGKTLPRTLLDILADGTILKVGVGCSEDASKLLQDYGLVVRGCLDLRYLAMRQRNNLLCNGLSLKSLAETVLNFPLDKSLLLRCSNWDAETLTEDQVIYAARDAQISVALFLHLLGYPFSRNSPGEKNDDHSSWRKVLEKCQGVVDIPFRSKGMSRLGEEVNGEATESQQKPRNKKSKMDGMVPGNHQGRDPRKHKRKPLGVGYSARKSPLYDNCFLHAPDGQPLCTCDRRKAQWYLDKGIGELVSEEPFVVKLRFEPAGRPESPGDYYLMVKENLCVVCGKRDSYIRKNVIPHEYRKHFPIEMKDHNSHDVLLLCTSCHAISNYYDNHLKQQLAKEFQAPIGSEEGLRLLEDPERRQVRSGARALLNAESLPTQRKEELLQALREFYNTDVVTEEMLQEAASLETRISNENYVPHGLKVVQCHSQGGLRSLMQLESRWRQHFLDSMQPKHLPQQWSVDHNHQKLLRKFGEDLPIQLS

SEQ ID NO: 2539 - protein, 255 aa, Homo sapiens
MDDFISISLLSLAMLVGCYVAGIIPLAVNFSEERLKLVTVLGAGLLCGTALAVIVPEGVHALYEDILEGKHHQASETHNVIASDKAAEKSVVHEHEHSHDHTQLHAYIGVSLVLGFVFMLLVDQIGNSHVHSTDDPEAARSSNSKITTTLGLVVHAAADGVALGAAASTSQTSVQLIVFVAIMLHKAPAAFGLVSFLMHAGLERNRIRKHLLVFALAAPVMSMVTYLGLSKSSKEALSEVNATGVAMLFSAGTFL

SEQ ID NO: 2540 - protein, 255 aa, Homo sapiens
MSGCRVFIGRLNPAAREKDVERFFKGYGRIRDIDLKRGFGFVEFEDPRDADDAVYELDGKELCSERVTIEHARARSRGGRGRGRYSDRFSSRRPRNDRRNAPPVRTENRLIVENLSSRVSWQDLKDFMRQAGEVTFADAHRPKLNEGVVEFASYGDLKNAIEKLSGKEINGRKIKLIEGSKRHSRSRSRSRSRTRSSSRSRSRSRSRSRKSYSRSRSRSRSRSRSKSRSVSRSPVPEKSQKRGSSSRSKSPASVD

SEQ ID NO: 2541 - protein, 255 aa, Homo sapiens
MGSQTLQILRQGVWAALSGGWYYDPHQATFVNALHLYLWLFLLGLPFTLYMALPSTMIIVAVYCPVIAAVFIVLKMVNYRLHRALDAGEVVDRTANEFTDQRTKAEQGNCSTRRKDSNGPSDPGGGIEMSEFIREATPPVGCSSRNSYAGLDPSNQIGSGSSRLGTAATIKGDTDTAKTSDDISLSLGQSSSLCKEGSEEQDLAADRKLFRLVSNDSFISIQPSLSSCGQDLPRDFSDKVNLPSHNHHHHVDQSL

SEQ ID NO: 2542 - protein, 1803 aa, Homo sapiens [sequence omitted]

SEQ ID NO: 2543 - protein, 255 aa, Homo sapiens
MYPNWGRYGGSSHYPPPPVPPPPPVALPEASPGPGYSSSTTPAAPSSSGFMSFREQHLAQLQQLQQMHQKQMQCVLQPHHLPPPPLPPPPVMPGGGYGDWQPPPPPMPPPPGPALSYQKQQQYKHQMLHHQRDGPPGLVPMELESPPESPPVPPGSYMPPSQSYMPPPQPPPSYYPPTSSQPYLPPAQPSPSQSPPSQSYLAPTPSYSSSSSSSQSYLSHSQSYLPSSQASPSRPSQGHSKSQLLAPPPPSAPPG

SEQ ID NO: 2544 - protein, 125 aa, Homo sapiens
MPHSSDSSDSSFSRSPPPGKQDSSDDVRRVQRREKNRIAAQKSRQRQTQKADTLHLESEDLEKQNAALRKEIKQLTEELKYFTSVLNSHEPLCSVLAASTPSPPEVVYSAHAFHQPHVSSPRFQP

SEQ ID NO: 2545 - protein, 255 aa, Homo sapiens
MVNEGPNQEESDDTPVPESALQADPSVSVHPSVSVHPSVSINPSVSVHPSSSAHPSALAQPSGLAHPSSSGPEDLSVIKVSRRRWAVVLVFSCYSMCNSFQWIQYGSINNIFMHFYGVSAFAIDWLSMCYMLTYIPLLLPVAWLLEKFGLRTIALTGSALNCLGAWVKLGSLKPHLFPVTVVGQLICSVAQVFILGMPSRIASVWFGANEVSTACSVAVFGNQLGIAIGFLVPPVLVPNIEDRDELAYHISIMFY

SEQ ID NO: 2546 - protein, 255 aa, Homo sapiens
MNSTCIEEQHDLDHYLFPIVYIFVIIVSIPANIGSLCVSFLQAKKESELGIYLFSLSLSDLLYALTLPLWIDYTWNKDNWTFSPALCKGSAFLMYMNFYSSTAFLTCIAVDRYLAVVYPLKFFFLRTRRFALMVSLSIWILETIFNAVMLWEDETVVEYCDAEKSNFTLCYDKYPLEKWQINLNLFRTCTGYAIPLVTILICNRKVYQAVRHNKATENKEKKRIIKLLVSITVTFVLCFTPFHVMLLIRCILEHA

SEQ ID NO: 2547 - protein, 255 aa, Homo sapiens
MSQEGDYGRWTISSSDESEEEKPKPDKPSTSSLLCARQGAANEPRYTCSEAQKAAHKRKISPVKFSNTDSVLPPKRQKSGSQEDLGWCLSSSDDELQPEMPQKQAEKVVIKKEKDISAPNDGTAQRTENHGAPACHRLKEEEDEYETSGEGQDIWDMLDKGNPFQFYLTRVSGVKPKYNSGALHIKDILSPLFGTLVSSAQFNYCFDVDWLVKQYPPEFRKKPILLVHGDKREAKAHLHAQAKPYENISLCQAKL

SEQ ID NO: 2548 - protein, 255 aa, Homo sapiens
MATSEQSICQARASVMVYDDTSKKWVPIKPGQQGFSRINIYHNTASNTFRVVGVKLQDQQVVINYSIVKGLKYNQATPTFHQWRDARQVYGLNFASKEEATTFSNAMLFALNIMNSQEGGPSSQRQVQNGPSPDEMDIQRRQVMEQHQQQRQESLERRTSATGPILPPGHPSSAASAPVSCSGPPPPPPPPVPPPPTGATPPPPPPLPAGGAQGSSHDESSMSGLAAAIAGAKLRRVQRPEDASGGSSPSGTSKS

SEQ ID NO: 2549 - protein, 255 aa, Homo sapiens
MADAEPEAGGGSEDGGGGGGPAPPGQSGSVARVAPLGPEQLRQVLEQVTKAQPPPPPPPFVLRDAARRLRDAAQQAALQRGRGTEPPRLPRLLPPQQLEAICVKVTSGETKGQERPMLLPTTIQPQTARKSQLPRGNSCLVGLHIASPQLLRVQPLVRTEPQSCFLSDLCQPPAQGFVQRPLPALQVVPAKRVPAPKAPDEQGSMLTPLSASDPLAVTSLSSSSAHPFISNLHTRHTEKLKKSLKVKTRSGRVSR

SEQ ID NO: 2550 - protein, 255 aa, Homo sapiens
MLRKLTIEQINDWFTIGKTVTNVELLGAPPAFPAGAAREEVQRQDVAPGAGPAAQAPALAQAPARPAAAFERSLSQRSSEVEYINKYRQLEAQELDVCRSVQPTSGPGPRPSLAKLSSVTCIPGTTYKYPDLPISRYKEEVVSLIESNSVVIIHGATGSGKSTQLPQYILDHYVQRSAYCSIVVTQPRKIGASSIARWISKERAWTLGGVVGYQVGLEKIATEDTRLIYMTTGVLLQKIVSAKSLMEFTHIIIDE

SEQ ID NO: 2551 - protein, 255 aa, Homo sapiens
MSVKEGAQRKWAALKEKLGPQDSDPTEANLESADPELCIRLLQMPSVVNYSGLRKRLEGSDGGWMVQFLEQSGLDLLLEALARLSGRGVARISDALLQLTCVSCVRAVMNSRQGIEYILSNQGYVRQLSQALDTSNVMVKKQVFELLAALCIYSPEGHVLTLDALDHYKTVCSQQYRFSIVMNELSGSDNVPYVVTLLSVINAVILGPEDLRARTQLRNEFIGLQLLDVLARLRDLEDADLLIQLEAFEEAKAED

SEQ ID NO: 2552 - protein, 255 aa, Homo sapiens
MLKPLWKAAVAPTWPCSMPPRRPWDREAGTLQVLGALAVLWLGSVALICLLWQVPRPPTWGQVQPKDVPRSWEHGSSPAWEPLEAEARQQRDSCQLVLVESIPQDLPSAAGSPSAQPLGQAWLQLLDTAQESVHVASYYWSLTGPDIGVNDSSSQLGEALLQKLQQLLGRNISLAVATSSPTLARTSTDLQVLAARGAHVRQVPMGRLTRGVLHSKFWVVDGRHIYMGSANMDWRSLTQVKELGAVIYNCSHLAQ

SEQ ID NO: 2553 - protein, 150 aa, Homo sapiens
MDSRKLSPRGKKLESHLSQEHRRPPLGLIAAWGQPSIQSSVQQGLQTQDWVCEPPERRRPGRRWSVSIDERRRLATLGGRERPGAAGTQLHCRDVVQMVAQLVSEDVDKDVLLPHPLRSTESTNAFQAFLARSAPFWHNATFEASRSPPS

SEQ ID NO: 2554 - protein, 371 aa, Homo sapiens
MAELQEVQITEEKPLLPGQTPEAAKEAELAARILLDQGQTHSVETPYGSVTFTVYGTPKPKRPAILTYHDVGLNYKSCFQPLFQFEDMQEIIQNFVRVHVDAPGMEEGAPVFPLGYQYPSLDQLADMIPCVLQYLNFSTIIGVGVGAGAYILARYALNHPDTVEGLVLINIDPNAKGWMDWAAHKLTGLTSSIPEMILGHLFSQEELSGNSELIQKYRNIITHAPNLDNIELYWNSYNNRRDLNFERGGDITLRCPVMLVVGDQAPHEDAVVECNSKLDPTQTSFLKMADSGGQPQLTQPGKLTEAFKYFLQGMGYMASSCMTRLSRSRTASLTSAASVDGNRSRSRTLSQSSESGTLSSGPPGHTMEVSC

SEQ ID NO: 2555 - protein, 113 aa, Homo sapiens
MSASVVSVISRFLEEYLSSTPQRLKLLDAYLLYILLTGALQFGYCLLVGTFPFNSFLSGFISCVGSFILAVCLRIQINPQNKADFQGISPERAFADFLFASTILHLVVMNFVG

SEQ ID NO: 2556 - protein, 255 aa, Homo sapiens
MEEGARHRNNTEKKHPGGGESDASPEAGSGGGGVALKKEIGLVSACGIIVGNIIGSGIFVSPKGVLENAGSVGLALIVWIVTGFITVVGALCYAELGVTIPKSGGDYSYVKDIFGGLAGFLRLWIAVLVIYPTNQAVIALTFSNYVLQPLFPTCFPPESGLRLLAAICLLLLTWVNCSSVRWATRVQDIFTAGKLLALALIIIMGIVQICKGEYFWLEPKNAFENFQEPDIGLVALAFLQGSFAYGGWNFLNYVT

SEQ ID NO: 2557 - protein, 757 aa, Homo sapiens
MGETPKHFAVQVVDMLALHLPPEKLCPQLMPMLEEALRSESPYQRKAGLLVLAVLSDGAGDHIRQRLLPPLLQIVCKGLEDPSQVVRNAALFALGQFSENLQPHISSYSREVMPLLLAYLKSVPLGHTHHLAKACYALENFVENLGPKVQPYLPELMECMLQLLRNPSSPRAKELAVSALGAIATAAQASLLPYFPAIMEHLREFLLTGREDLQPVQIQSLETLGVLARAVGEPMRPLAEECCQLGLGLCDQVDDPDLRRCTYSLFAALSGLMGEGLAPHLEQITTLMLLSLRSTEGIVPQYDGSSSFLLFDDESDGEEEEELMDEDVEEEDDSEISGYSVENAFFDEKEDTCAAVGEISVNTSVAFLPYMESVFEEVFKLLECPHLNVRKAAHEALGQFCCALHKACQSCPSEPNTAALQAALARVVPSYMQAVNRERERQVVMAVLEALTGVLRSCGTLTLKPPGRLAELCGVLKAVLQRKTACQDTDEEEEEEDDDQAEYDAMLLEHAGEAIPALAAAAGGDSFAPFFAGFLPLLVCKTKQGCTVAEKSFAVGTLAETIQGLGAASAQFVSRLLPVLLSTAQEADPEVRSNAIFGMGVLAEHGGHPAQEHFPKLLGLLFPLLARERHDRVRDNICGALARLLMASPTRKPEPQVLAALLHALPLKEDLEEWVTIGRLFSFLYQSSPDQVIDVAPELLRICSLILADNKIPPDTKAALLLLLTFLAKQHTDSFQAALGSLPVDKAQELQAVLGLS

SEQ ID NO: 2558 - protein, 255 aa, Homo sapiens
MTVVGNPRSWSCQWLPILILLLGTGHGPGVEGVTHYKAGDPVILYVNKVGPYHNPQETYHYYQLPVCCPEKIRHKSLSLGEVLDGDRMAESLYEIRFRENVEKRILCHMQLSSAQVEQLRQAIEELYYFEFVVDDLPIRGFVGYMEESGFLPHSHKIGLWTHLDFHLEFHGDRIIFANVSVRDVKPHSLDGLRPDEFLGLTHTYSVRWSETSVERRSDRRRGDDGGFFPRTLEIHWLSIINSMVLVFLLVGFVAV

SEQ ID NO: 2559 - protein, 255 aa, Homo sapiens
MARLFSPRPPPSEDLFYETYYSLSQQYPLLLLLLGIVLCALAALLAVAWASGRELTSDPSFLTTVLCALGGFSLLLGLASREQRLQRWTRPLSGLVWVALLALGHAFLFTGGVVSAWDQVSYFLFVIFTAYAMLPLGMRDAAVAGLASSLSHLLVLGLYLGPQPDSRPALLPQLAANAVLFLCGNVAGVYHKALMERALRATFREALSSLHSRRRLDTEKKHQEHLLLSILPAYLAREMKAEIMARLQAGQGSRP

SEQ ID NO: 2560 - protein, 255 aa, Homo sapiens
MSCVKLWPSGAPAPLVSIEELENQELVGKGGFGTVFRAQHRKWGYDVAVKIVNSKAISREVKAMASLDNEFVLRLEGVIEKVNWDQDPKPALVTKFMENGSLSGLLQSQCPRPWPLLCRLLKEVVLGMFYLHDQNPVLLHRDLKPSNVLLDPELHVKLADFGLSTFQGGSQSGTGSGEPGGTLGYLAPELFVNVNRKASTASDVYSFGILMWAVLAGREVELPTEPSLVYEAVCNRQNRPSLAELPQAGPETPGL

SEQ ID NO: 2561 - protein, 255 aa, Homo sapiens
MNRLPDDYDPYAVEEPSDEEPALSSSEDEVDVLLHGTPDQKRKLIRECLTGESESSSEDEFEKEMEAELNSTMKTMEDKLSSLGTGSSSGNGKVATAPTRYYDDIYFDSDSEDEDRAVQVTKKKKKKQHKIPTNDELLYDPEKDNRDQAWVDAQRRGYHGLGPQRSRQQQPVPNSDAVLNCPACMTTLCLDCQRHESYKTQYRAMFVMNCSINKEEVLRYKASENRKKRRVHKKMRSNREDAAEKAETDVEEIYH

SEQ ID NO: 2562 - protein, 255 aa, Homo sapiens
MPLLHRKPFVRQKPPADLRPDEEVFYCKVTNEIFRHYDDFFERTILCNSLVWSCAVTGRPGLTYQEALESEKKARQNLQSFPEPLIIPVLYLTSLTHRSRLHEICDDIFAYVKDRYFVEETVEVIRNNGARLQCRILEVLPPSHQNGFANGHVNSVDGETIIISDSDDSETQSCSFQNGKKKDAIDPLLFKYKVQPTKKELHESAIVKATQISRRKHLFSRDKLKLFLKQHCEPQDGVIKIKASSLSTYKIAEQD

SEQ ID NO: 2563 - protein, 255 aa, Homo sapiens
MFQAAERPQEWAMEGPRDGLKKERLLDDRHDSGLDSMKDEEYEQMVKELQEIRLEPQEVPRGSEPWKQQLTEDGDSFLHLAIIHEEKALTMEVIRQVKGDLAFLNFQNNLQQTPLHLAVITNQPEIAEALLGAGCDPELRDFRGNTPLHLACEQGCLASVGVLTQSCTTPHLHSILKATNYNGHTCLHLASIHGYLGIVELLVSLGADVNAQEPCNGRTALHLAVDLQNPDLVSLLLKCGADVNRVTYQGYSPYQ

SEQ ID NO: 2564 - protein, 255 aa, Homo sapiens
MTTYLEFIQQNEERDGVRFSWNVWPSSRLEATRMVVPVAALFTPLKERPDLPPIQYEPVLCSRTTCRAVLNPLCQVDYRAKLWACNFCYQRNQFPPSYAGISELNQPAELLPQFSSIEYVVLRGPQMPLIFLYVVDTCMEDEDLQALKESMQMSLSLLPPTALVGLITFGRMVQVHELGCEGISKSYVFRGTKDLSAKQLQEMLGLSKVPLTQATRGPQVQQPPPSNRFLQPVQKIDMNLTDLLGELQRDPWPVP

SEQ ID NO: 2565 - protein, 255 aa, Homo sapiens
MAKAAASSSLEDLDLSGEEVQRLTSAFQDPEFRRMFSQYAEELTDPENRRRYEAEITALERERGVEVRFVHPEPGHVLRTSLDGARRCFVNVCSNALVGAPSSRPGSGGDRGAAPGSHWSLPYSLAPGREYAGRSSSRYMVYDVVFHPDALALARRHEGFRQMLDATALEAVEKQFGVKLDRRNAKTLKAKYKGTPEAAVLRTPLPGVIPARPDGEPKGPLPDFPYPYQYPAAPGPRAPSPPEAALQPAPTEPRY

SEQ ID NO: 2566 - protein, 144 aa, Homo sapiens
MADTLESSLEDPLRSFVRVLEKRDGTVLRLQQYSSGGVGCVVWDAAIVLSKYLETPEFSGDGAHALSRRSVLELGSGTGAVGLMAATLGADVVVTDLEELQDLLKMNINMNKHLVTGSVQAKGGRNRRLSFSTRLHTDGRLHIL

SEQ ID NO: 2567 - protein, 255 aa, Homo sapiens
MQQAPQPYEFFSEENSPKWRGLLVSALRKVQEQVHPTLSANEESLYYIEELIFQLLNKLCMAQPRTVQDVEERVQKTFPHPIDKWAIADAQSAIEKRKRRNPLLLPVDKIHPSLKEVLGYKVDYHVSLYIVAVLEYISADILKLAGNYVFNIRHYEISQQDIKVSMCADKVLMDMFDQDDIGLVSLCEDEPSSSGELNYYDLVRTEIAEERQYLRELNMIIKVFREAFLSDRKLFKPSDIEKIFSNISDIHELTV

SEQ ID NO: 2568 - protein, 255 aa, Homo sapiens
MDEVEQDQHEARLKELFDSFDTTGTGSLGQEELTDLCHMLSLEEVAPVLQQTLLQDNLLGRVHFDQFKEALILILSRTLSNEEHFQEPDCSLEAQPKYVRGGKRYGRRSLPEFQESVEEFPEVTVIEPLDEEARPSHIPAGDCSEHWKTQRSEEYEAEGQLRFWNPDDLNASQSGSSPPQDWIEEKLQEVCEDLGITRDGHLNRKKLVSICEQYGLQNVDGEMLEEVFHNLDPDGTMSVEDFFYGLFKNGKSLTP

SEQ ID NO: 2569 - protein, 255 aa, Homo sapiens
MAKPLTDQEKRRQISIRGIVGVENVAELKKSFNRHLHFTLVKDRNVATTRDYYFALAHTVRDHLVGRWIRTQQHYYDKCPKRVYYLSLEFYMGRTLQNTMINLGLQNACDEAIYQLGLDIEELEEIEEDAGLGNGGLGRLAACFLDSMATLGLAAYGYGIRYEYGIFNQKIRDGWQVEEADDWLRYGNPWEKSRPEFMLPVHFYGKVEHTNTGTKWIDTQVVLALPYDTPVPGYMNNTVNTMRLWSARAPNDFNL

SEQ ID NO: 2570 - protein, 144 aa, Homo sapiens
MAFTFAAFCYMLALLLTAALIFFAIWHIIAFDELKTDYKNPIDQCNTLNPLVLPEYLIHAFFCVMFLCAAEWLTLGLNMPLLAYHIWRYMSRPVMSGPGLYDPTTIMNADILAYCQKEGWCKLAFYLLAFFYYLYGMIYVLVSS

SEQ ID NO: 2571 - protein, 255 aa, Homo sapiens
MNWELLLWLLVLCALLLLLVQLLRFLRADGDLTLLWAEWQGRRPEWELTDMVVWVTGASSGIGEELAYQLSKLGVSLVLSARRVHELERVKRRCLENGNLKEKDILVLPLDLTDTGSHEAATKAVLQEFGRIDILVNNGGMSQRSLCMDTSLDVYRKLIELNYLGTVSLTKCVLPHMIERKQGKIVTVNSILGIISVPLSIGYCASKHALRGFFNGLRTELATYPGIIVSNICPGPVQSNIVENSLAGEVTKTIG

SEQ ID NO: 2572 - protein, 255 aa, Homo sapiens
MEKIEEQFANLHIVKCSLGTKEPTYLLGIDTSKTVQAGKENLVAVLCSNGSIRIYDKERLNVLREFSGYPGLLNGVRFANSCDSVYSACTDGTVKCWDARVAREKPVQLFKGYPSNIFISFDINCNDHIICAGTEKVDDDALLVFWDARMNSQNLSTTKDSLGAYSETHSDDVTQVRFHPSNPNMVVSGSSDGLVNVFDINIDNEEDALVTTCNSISSVSCIGWSGKGYKQIYCMTHDEGFYWWDLNHLDTDEPV

SEQ ID NO: 2573 - protein, 255 aa, Homo sapiens
MDHYDSQQTNDYMQPEEDWDRDLLLDPAWEKQQRKTFTAWCNSHLRKAGTQIENIEEDFRDGLKLMLLLEVISGERLAKPERGKMRVHKISNVNKALDFIASKGVKLVSIGAEEIVDGNVKMTLGMIWTIILRFAIQDISVEETSAKEGLLLWCQRKTAPYKNVNIQNFHISWKDGLGFCALIHRHRPELIDYGKLRKDDPLTNLNTAFDVAEKYLDIPKMLDAEDIVGTARPDEKAIMTYVSSFYHAFSGAQKA

SEQ ID NO: 2574 - protein, 255 aa, Homo sapiens
MNKLRQSFRRKKDVYVPEASRPHQWQTDEEGVRTGKCSFPVKYLGHVEVDESRGMHICEDAVKRLKAERKFFKGFFGKTGKKAVKAVLWVSADGLRVVDEKTKDLIVDQTIEKVSFCAPDRNFDRAFSYICRDGTTRRWICHCFMAVKDTGERLSHAVGCAFAACLERKQKREKECGVTATFDASRTTFTREGSFRVTTATEQAEREEIMKQMQDAKKAETDKIVVGSSVAPGNTAPSPSSPTSPTSDATTSLEM

SEQ ID NO: 2575 - protein, 255 aa, Homo sapiens
MNLQAQPKAQNKRKRCLFGGQEPAPKEQPPPLQPPQQSIRVKEEQYLGHEGPGGAVSTSQPVELPPPSSLALLNSVVYGPERTSAAMLSQQVASVKWPNSVMAPGRGPERGGGGGVSDSSWQQQPGQPPPHSTWNCHSLSLYSATKGSPHPGVGVPTYYNHPEALKREKAGGPQLDRYVRPMMPQKVQLEVGRPQAPLNSFHAAKKPPNQSLPLQPFQLAFGHQVNRQVFRQGPPPPNPVAAFPPQKQQQQQQPQ

SEQ ID NO: 2576 - protein, 255 aa, Homo sapiens
MAVAGPAPGAGARPRLDLQFLQRFLQILKVLFPSWSSQNALMFLTLLCLTLLEQFVIYQVGLIPSQYYGVLGNKDLEGFKTLTFLAVMLIVLNSTLKSFDQFTCNLLYVSWRKDLTEHLHRLYFRGRAYYTLNVLRDDIDNPDQRISQDVERFCRQLSSMASKLIISPFTLVYYTYQCFQSTGWLGPVSIFGYFILGTVVNKTLMGPIVMKLVHQEKLEGDFRFKHMQIRVNAEPAAFYRAGHVEHMRTDRRLQR

SEQ ID NO: 2577 - protein, 255 aa, Homo sapiens
MFYVIGGITVSVVAFFFTIKFLFELAARVVSFLQNEDRERRGDRTIYDYVRGNYLDPRSCKVSWDWKDPYEVGHSMAFRVHLFYKNGQPFPAHRPVGLRVHISHVELAVEIPVTQEVLQEPNSNVVKVAFTVRKAGRYEITVKLGGLNVAYSPYYKIFQPGMVVPSKTKIVCHFSTLVLTCGQPHTLQIVPRDEYDNPTNNSMSLRDEHNYTLSIHELGPQEEESTGVSFEKSVTSNRQTFQVFLRLTLHSRGCF

SEQ ID NO: 2578 - protein, 255 aa, Homo sapiens
MSVLGEYERHCDSINSDFGSESGGCGDSSPGPSASQGPRAGGGAAEQEELHYIPIRVLGRGAFGEATLYRRTEDDSLVVWKEVDLTRLSEKERRDALNEIVILALLQHDNIIAYYNHFMDNTTLLIELEYCNGGNLYDKILRQKDKLFEEEMVVWYLFQIVSAVSCIHKAGILHRDIKTLNIFLTKANLIKLGDYGLAKKLNSEYSMAETLVGTPYYMSPELCQGVKYNFKSDIWAVGCVIFELLTLKRTFDATN

SEQ ID NO: 2579 - protein, 255 aa, Homo sapiens
MIASCLCYLLLPATRLFRALSDAFFTCRKNVLLANSSSPQVEGDFAMAPRGPEQEECEGLLQQWREEGLSQVLSTASEGPLIDKGLAQSSLALLMDNPGEENAASEDRWSSRQLSDLRAAENLDEPFPEMLGEEPLLEVEGVEGSMWAAIPMQSEPQYADCAALPVGALATEQWEEDPAVLAWSIAPEPVPQEEASIWPFEGLGQLQPPAVEIPYHEILWREWEDFSTQPDAQGLKAGDGPQFQFTLMSYNILAQ

SEQ ID NO: 2580 - protein, 255 aa, Homo sapiens
MRPEPGGCCCRRTVRANGCVANGEVRNGYVRSSAAAAAAAAAGQIHHVTQNGGLYKRPFNEAFEETPMLVAVLTYVGYGVLTLFGYLRDFLRYWRIEKCHHATEREEQKDFVSLYQDFENFYTRNLYMRIRDNWNRPICSVPGARVDIMERQSHDYNWSFKYTGNIIKGVINMGSYNYLGFARNTGSCQEAAAKVLEEYGAGVCSTRQEIGNLDKHEELEELVARFLGVEAAMAYGMGFATNSMNIPALVGKGCL

SEQ ID NO: 2581 - protein, 255 aa, Homo sapiens
MPLLLYTCLLWLPTSGLWTVQAMDPNAAYVNMSNHHRGLASANVDFAFSLYKHLVALSPKKNIFISPVSISMALAMLSLGTCGHTRAQLLQGLGFNLTERSETEIHQGFQHLHQLFAKSDTSLEMTMGNALFLDGSLELLESFSADIKHYYESEVLAMNFQDWATASRQINSYVKNKTQGKIVDLFSGLDSPAILVLVNYIFFKGTWTQPFDLASTREENFYVDETTVVKVPMMLQSSTISYLHDAELPCQLVQM

SEQ ID NO: 2582 - protein, 255 aa, Homo sapiens
MKSPALQPLSMAGLQLMTPASSPMGPFFGLPWQQEAIHDNIYTPRKYQVELLEAALDHNTIVCLNTGSGKTFIAVLLTKELSYQIRGDFSRNGKRTVFLVNSANQVAQQVSAVRTHSDLKVGEYSNLEVNASWTKERWNQEFTKHQVLIMTCYVALNVLKNGYLSLSDINLLVFDECHLAILDHPYREIMKLCENCPSCPRILGLTASILNGKCDPEELEEKIQKLEKILKSNAETATDLVVLDRYTSQPCEIVV

SEQ ID NO: 2583 - protein, 255 aa, Homo sapiens
MSRRKQGNPQHLSQRELITPEADHVEAAILEEDEGLEIEEPSGLGLMVGGPDPDLLTCGQCQMNFPLGDILVFIEHKRKQCGGSLGACYDKALDKDSPPPSSRSELRKVSEPVEIGIQVTPDEDDHLLSPTKGICPKQENIAGPCRPAQLPAVAPIAASSHPHSSVITSPLRALGALPPCLPLPCCSARPVSGDGTQGEGQTEAPFGCQCQLSGKDEPSSYICTTCKQPFNSAWFLLQHAQNTHGFRIYLEPGPA

SEQ ID NO: 2584 - protein, 255 aa, Homo sapiens
MPWDARRPGGGADGGPEASGAARSRAQKQCRKSSFAFYQAVRDLLPVWLLEDMRASEAFHWDERGRAAAYSPSEALLYALVHDHQAYAHYLLATFPRRALAPPSAGFRCCAAPGPHVALAVRYNRVGILRRILRTLRDFPAEERARVLDRRGCSRVEGGGTSLHVACELARPECLFLLLGHGASPGLRDGGGLTPLELLLRQLGRDAGATPSAAGAPASAPGEPRQRRLLLLDLLALYTPVGAAGSARQELLGDR

SEQ ID NO: 2585 - protein, 255 aa, Homo sapiens
MMPMILTVFLSNNEQILTEVPITPETTCRDVVEFCKEPGEGSCHLAEVWRGNERPIPFDHMMYEHLQKWGPRREEVKFFLRHEDSPTENSEQGGRQTQEQRTQRNVINVPGEKRTENGVGNPRVELTLSELQDMAARQQQQIENQQQMLVAKEQRLHFLKQQERRQQQSISENEKLQKLKERVEAQENKLKKIRAMRGQVDYSKIMNGNLSAEIERFSAMFQEKKQEVQTAILRVDQLSQQLEDLKKGKLNGFQS

SEQ ID NO: 2586 - protein, 255 aa, Homo sapiens
MSDVAIVKEGWLHKRGEYIKTWRPRYFLLKNDGTFIGYKERPQDVDQREAPLNNFSVAQCQLMKTERPRPNTFIIRCLQWTTVIERTFHVETPEEREEWTTAIQTVADGLKKQEEEEMDFRSGSPSDNSGAEEMEVSLAKPKHRVTMNEFEYLKLLGKGTFGKVILVKEKATGRYYAMKILKKEVIVAKDEVAHTLTENRVLQNSRHPFLTALKYSFQTHDRLCFVMEYANGGELFFHLSRERVFSEDRARFYGA

SEQ ID NO: 2587 - protein, 255 aa, Homo sapiens
MHDFRRTVKEVISVVKVCESTLRKRLTEFEDTPTSQLTIDEFMKIDLEEECDPPSYTAGQRKLRMKQLEQVLSKKLEEVEGEISSYQDAIEIELENSRPKAKGGLASLAKDGSTEDTASSLCGEEDTEDEELEAAASHLNKDLYRELLGGAPGSSEAAGSPEWGGRPPALGSLLDPLPTAASLGISDSIRECISSQSSDPKDASGDGELDLSGIDDLEIDRYILNESEARVKAELWMRENAEYLREQREKEARIA

SEQ ID NO: 2588 - protein, 255 aa, Homo sapiens
MARHGPPWSRLDAQQERDVRELVRGVAGLQDEADPNFQLALNFAWSNFRFHRFLDVNSHKIEKTIEGIYEKFVIHSDLSKAASWKRLTEEFLNAPLPSIKEIKTDAHYSILSLLLCLSDSPSNSSYVETPRNKEVEKKDDFDWGKYLMEDEEMDIGPYMDTPNWSEESEEENDQQPLSREDSGIQVDRTPLEEQDQNRKLDPCISWKDEPDDRSWLEHHVVHQYWTARPSQFPHSLHLHSNLAAVWDQHLYSSDP

SEQ ID NO: 2589 - protein, 240 aa, Homo sapiens [sequence omitted]

SEQ ID NO: 2590 - protein, 255 aa, Homo sapiens
MAHRKLESVGSGMLDHRVRPGPVPHSQEPESEDMELPLEGYVPEGLELAALRPESPAPEEQECHNHSPDGDSSSDYVNNTSEEEDYDEGLPEEEEGITYYIRYCPEDDSYLEGMDCNGEEYLAHSAHPVDTDECQEAVEEWTDSAGPHPHGHEAEGSQDYPDGQLPIPEDEPSVLEAHDQEEDGHYCASKEGYQDYYPEEANGNTGASPYRLRRGDGDLEDQEEDIDQIVAEIKMSLSMTSITSASEASPEHGPE

SEQ ID NO: 2591 - protein, 255 aa, Homo sapiens
MMSEGKPPDKKRPRRSLSISKNKKKASNSIISCFNNAPPAKLACPVCSKMVPRYDLNRHLDEMCANNDFVQVDPGQVGLINSNVSMVDLTSVTLEDVTPKKSPPPKTNLTPGQSDSAKREVKQKISPYFKSNDVVCKNQDELRNRSVKVICLGSLASKLSRKYVKAKKSIDKDEEFAGSSPQSSKSTVVKSLIDNSSEIEDEDQILENSSQKENVFKCDSLKEECIPEHMVRGSKIMEAESQKATRECEKSALTP

SEQ ID NO: 2592 - protein, 255 aa, Homo sapiens
MAEGGEGGEDEIQFLRTEDEVVLQCIATIHKEQRKFCLAAEGLGNRLCFLEPTSEAKYIPPDLCVCNFVLEQSLSVRALQEMLANTGENGGEGAAQGGGHRTLLYGHAVLLRHSFSGMYLTCLTTSRSQTDKLAFDVGLREHATGEACWWTIHPASKQRSEGEKVRIGDDLILVSVSSERYLHLSVSNGNIQVDASFMQTLWNVHPTCSGSSIEEGYLLGGHVVRLFHGHDECLTIPSTDQNDSQHRRIFYEAGG

SEQ ID NO: 2593 - protein, 255 aa, Homo sapiens
MTHTRRKSLPMLSSGLTGRREPLQMEDSNMEQGVEGVEPGMPESPGHLTGRRKNYPLRKRPLVPEKPKACKVLLTRLENVAGPRSADEADELPPDLPKPPSPAPSSEDPGLAQPRKRRLASLNAEALNNLLLEREDTSSLAGTRRSRAGDPHRSRDRDRATGGWSSSKKRPRLGDLGGGSRDLSPEPAPDEGPRRDGDPAPKRLASLNAAAFLKLSQERELPLRLPRAHAEVDGRSTEPPAPKAPRPKWPKVNGK

SEQ ID NO: 2594 - protein, 195 aa, Homo sapiens
MGSRASTLLRDEELEEIKKETGFSHSQITRLYSRFTSLDKGENGTLSREDFQRIPELAINPLGDRIINAFFPEGEDQVNFRGFMRTLAHFRPIEDNEKSKDVNGPEPLNSRSNKLHFAFRLYDLDKDEKISRDELLQVLRMMVGVNISDEQLGSIADRTIQEADQDGDSAISFTEFVKVLEKVDVEQKMSIRFLH

SEQ ID NO: 2595 - protein, 255 aa, Homo sapiens
MAEAALEAVRSELREFPAAARELCVPLAVPYLDKPPTPLHFYRDWVCPNRPCIIRNALQHWPALQKWSLPYFRATVGSTEVSVAVTPDGYADAVRGDRFMMPAERRLPLSFVLDVLEGRAQHPGVLYVQKQCSNLPSELPQLLPDLESHVPWASEALGKMPDAVNFWLGEAAAVTSLHKDHYENLYCVVSGEKHFLFHPPSDRPFIPYELYTPATYQLTEEGTFKVVDEEAMEKAEVSRTCLLTVRVLQAHRLPS

SEQ ID NO: 2596 - protein, 235 aa, Homo sapiens
MAAANPWDPASAPNGAGLVLGHFIASGMVNQEMLNMSKKTVSCFVNFTRLQQITNIQAEIYQKNLEIELLKLEKDTADVVHPFFLAQKCHTLQSMNNHLEAVLKEKRSLRQRLLKPMCQENLPIEAVYHRYMVHLLELAVTFIERLETHLETIRNIPHLAANLKKMNQALAKMDILVTETEELAENILKWRKQQNEVSSCIPKILAEESYLYKHDIIMPPLPFTSKVHVQTINAK

SEQ ID NO: 2597 - protein, 129 aa, Homo sapiens
MRRRGEIDMATEGDVELELETETSGPERPPEKPRKHDSGAADLERVTDYAEEKEIQSSNLETAMSVIGDRRSREQKAKQEREKELAKVTIKKEDLELIMTEMEISRAAAERSLREHMGNVVEALIALTN

SEQ ID NO: 2598 - protein, 119 aa, Homo sapiens
MSRSVALAVLALLSLSGLEAIQRTPKIQVYSRHPAENGKSNFLNCYVSGFHPSDIEVDLLKNGERIEKVEHSDLSFSKDWSFYLLYYTEFTPTEKDEYACRVNHVTLSQPKIVKWDRDM

SEQ ID NO: 2599 - protein, 255 aa, Homo sapiens
MEEELAIQQGQLETTLKELQTLRNMQKEAIAAHKENKLHLQQHVSMEFLKLHQFLHSKEKDILTELREEGKALNEEMELNLSQLQEQCLLAKDMLVSIQAKTEQQNSFDFLKDITTLLHSLEQGMKVLATRELISRKLNLGQYKGPIQYMVWREMQDTLCPGLSPLTLDPKTAHPNLVLSKSQTSVWHGDIKKIMPDDPERFDSSVAVLGSRGFTSGKWYWEVEVAKKTKWTVGVVRESIIRKGSCPLTPEQGFW

SEQ ID NO: 2600 - protein, 172 aa, Homo sapiens
MSVPGPSSPDGALTRPPYCLEAGEPTPGLSDTSPDEGLIEDLTIEDKAVEQLAEGLLSHYLPDLQRSKQALQELTQNQVVLLDTLEQEISKFKECHSMLDINALFAEAKHYHAKLVNIRKEMLMLHEKTSKLKKRALKLQQKRQKEELEREQQREKEFEREKQLTARPAKRM

SEQ ID NO: 2601 - protein, 255 aa, Homo sapiens
MVPLVAVVSGPRAQLFACLLRLGTQQVGPLQLHTGASHAARNHYEVLVLGGGSGGITMAARMKRKVGAENVAIVEPSERHFYQPIWTLVGAGAKQLSSSGRPTASVIPSGVEWIKARVTELNPDKNCIHTDDDEKISYRYLIIALGIQLDYEKIKGLPEGFAHPKIGSNYSVKTVEKTWKALQDFKEGNAIFTFPNTPVKCAGAPQKIMYLSEAYFRKTGKRSKANIIFNTSLGAIFGVKKYADALQEIIQERNL

SEQ ID NO: 2602 - protein, 255 aa, Homo sapiens
MPVLYDRLLKLKEMFNSKFGSIPKFYVRAPGRVNIIGEHIDYCGYSVLPMAVEQDVLIAVEPVKTYALQLANTNPLYPDFSTSANNIQIDKTKPLWHNYFLCGLKGIQEHFGLSNLTGMNCLVDGNIPPSSGLSSSSALVCCAGLVTLTVLGRNLSKVELAEICAKSERYIGTEGGGMDQSISFLAEEGTAKLIEFSPLRATDVKLPSGAVFVIANSCVEMNKAATSHFNIRVMECRLAAKLLAKYKSLQWDKVL

SEQ ID NO: 2603 - protein, 255 aa, Homo sapiens
MPAVASVPKELYLSSSLKDLNKKTEVKPEKISTKSYVHSALKIFKTAEECRLDRDEERAYVLYMKYVTVYNLIKKRPDFKQQQDYFHSILGPGNIKKAVEEAERLSESLKLRYEEAEVRKKLEEKDRQEEAQRLQQKRQETGREDGGTLAKGSLENVLDSKDKTQKSNGEKNEKCETKEKGAITAKELYTMMTDKNISLIIMDARRMQDYQDSCILHSLSVPEEAISPGVTASWIEAHLPDDSKDTWKKRGNVEY

SEQ ID NO: 2604 - protein, 255 aa, Homo sapiens
MARGAEGGRGDAGWGLRGALAAVALLSALNAAGTVFALCQWRGLSSALRALEAQRGREQREDSALRSFLAELSRAPRGASAPPQDPASSARNKRSHSGEPAPHIRAESHDMLMMMTYSMVPIRVMVDLCNSTKGICLTGPSGPPGPPGAGGLPGHNGLDGQPGPQGPKGEKGANGKRGKMGIPGAAGNPGERGEKGDHGELGLQGNEGPPGQKGEKGDKGDVSNDVLLAGAKGDQGPPGPPGPPGPPGPPGPPGS

SEQ ID NO: 2605 - protein, 255 aa, Homo sapiens
MAEKFESLMNIHGFDLGSRYMDLKPLGCGGNGLVFSAVDNDCDKRVAIKKIVLTDPQSVKHALREIKIIRRLDHDNIVKVFEILGPSGSQLTDDVGSLTELNSVYIVQEYMETDLANVLEQGPLLEEHARLFMYQLLRGLKYIHSANVLHRDLKPANLFINTEDLVLKIGDFGLARIMDPHYSHKGHLSEGLVTKWYRSPRLLLSPNNYTKAIDMWAAGCIFAEMLTGKTLFAGAHELEQMQLILESIPVVHEED

SEQ ID NO: 2606 - protein, 255 aa, Homo sapiens
MYRLMSAVTARAAAPGGLASSCGRRGVHQRAGLPPLGHGWVGGLGLGLGLALGVKLAGGLRGAAPAQSPAAPDPEASPLAEPPQEQSLAPWSPQTPAPPCSRCFARAIESSRDLLHRIKDEVGAPGIVVGVSVDGKEVWSEGLGYADVENRVPCKPETVMRIASISKSLTMVALAKLWEAGKLDLDIPVQHYVPEFPEKEYEGEKVSVTTRLLISHLSGIRHYEKDIKKVKEEKAYKALKMMKENVAFEQEKEGK

SEQ ID NO: 2607 - protein, 207 aa, Homo sapiens
MAKTYDYLFKLLLIGDSGVGKTCLLFRFSEDAFNTTFISTIGIDFKIRTIELDGKKIKLQIWDTAGQERFRTITTAYYRGAMGIMLVYDITNEKSFDNIKNWIRNIEEHASSDVERMILGNKCDMNDKRQVSKERGEKLAIDYGIKFLETSAKSSANVEEAFFTLARDIMTKLNRKMNDSNSAGAGGPVKITENRSKKTSFFRCSLL

SEQ ID NO: 2608 - protein, 255 aa, Homo sapiens
MTAAVFFGCAFIAFGPALALYVFTIATEPLRIIFLIAGAFFWLVSLLISSLVWFMARVIIDNKDGPTQKYLLIFGAFVSVYIQEMFRFAYYKLLKKASEGLKSINPGETAPSMRLLAYVSGLGFGIMSGVFSFVNTLSDSLGPGTVGIHGDSPQFFLYSAFMTLVIILLHVFWGIVFFDGCEKKKWGILLIVLLTHLLVSAQTFISSYYGINLASAFIILVLMGTWAFLAAGGSCRSLKLCLLCQDKNFLLYNQR

SEQ ID NO: 2609 - protein, 393 aa, Homo sapiens
MECPHLSSSVCIAPDSAKFPNGSPSSWCCSVCRSNKSPWVCLTCSSVHCGRYVNGHAKKHYEDAQVPLTNHKKSEKQDKVQHTVCMDCSSYSTYCYRCDDFVVNDTKLGLVQKVREHLQNLENSAFTADRHKKRKLLENSTLNSKLLKVNGSTTAICATGLRNLGNTCFMNAILQSLSNIEQFCCYFKELPAVELRNGKTAGRRTYHTRSQGDNNVSLVEEFRKTLCALWQGSQTAFSPESLFYVVWKIMPNFRGYQQQDAHEFMRYLLDHLHLELQGGFNGVSRSAILQENSTLSASNKCCINGASTVVTAIFGGILQNEVNCLICGTESRKFDPFLDLSLDIPSQFRSKRSKNQENGPVCSLRDCLRSFTDLEELDETELYMCHKCKKKKK

SEQ ID NO: 2610 - protein, 255 aa, Homo sapiens
MASGGGGCSASERLPPPFPGLEPESEGAAGGSEPEAGDSDTEGEDIFTGAAVVSKHQSPKITTSLLPINNGSKENGIHEEQDQEPQDLFADATVELSLDSTQNNQKKVLAKTLISLPPQEATNSSKPQPTYEELEEEEQEDQFDLTVGITDPEKIGDGMNAYVAYKVTTQTSLPLFRSKQFAVKRRFSDFLGLYEKLSEKHSQNGFIVPPPPEKSLIGMTKVKVGKEDSSSAEFLEKRRAALERYLQRIVNHPTM

SEQ ID NO: 2611 - protein, 255 aa, Homo sapiens
MIPKSLVQAAETQRGLCEPGGKGREGRSGGKGETRPRGVGTQEGKGTIPGSPREKRGERGEGDPALLPAEDLWRLPGSKDRLRSSLLPPPGPPSSDSGPGPPSSHSGKTAQGPRTLNWARKQSARTSSNLCAWSLAMATKMAEIPSSPYEPGQRGMKDTQRGDAPQRGSPEPRILQLARVGNVYLKEESSRSGRLEAKKWIPTKFLENLSVPHVDLGGNQLWSGGMEALTTQLGPGREGSSSPNSKQELQPYSGS

SEQ ID NO: 2612 - protein, 255 aa, Homo sapiens
MAAERGARRLLSTPSFWLYCLLLLGRRAPGAAAARSGSAPQSPGASIRTFTPFYFLVEPVDTLSVRGSSVILNCSAYSEPSPKIEWKKDGTFLNLVSDDRRQLLPDGSLFISNVVHSKHNKPDEGYYQCVATVESLGTIISRTAKLIVAGLPRFTSQPEPSSVYAGNNAILNCEVNADLVPFVRWEQNRQPLLLDDRVIKLPSGMLVISNATEGDGGLYRCVVESGGPPKYSDEVELKVLPDPEVISDLVFLKQP

SEQ ID NO: 2613 - protein, 255 aa, Homo sapiens
MAAPRVFPLSCAVQQYAWGKMGSNSEVARLLASSDPLAQIAEDKPYAELWMGTHPRGDAKILDNRISQKTLSQWIAENQDSLGSKVKDTFNGNLPFLFKVLSVETPLSIQAHPNKELAEKLHLQAPQHYPDANHKPEMAIALTPFQGLCGFRPVEEIVTFLKKVPEFQFLIGDEAATHLKQTMSHDSQAVASSLQSCFSHLMKSEKKVVVEQLNLLVKRISQQAAAGNNMEDIFGELLLQLHQQYPGDIGCFAIY

SEQ ID NO: 2614 - protein, 255 aa, Homo sapiens
MEPVGCCGECRGSSVDPRSTFVLSNLAEVVERVLTFLPAKALLRVACVCRLWRECVRRVLRTHRSVTWISAGLAEAGHLEGHCLVRVVAEELENVRILPHTVLYMADSETFISLEECRGHKRARKRTSMETALALEKLFPKQCQVLGIVTPGIVVTPMGSGSNRPQEIEIGESGFALLFPQIEGIKIQPFHFIKDPKNLTLERHQLTEVGLLDNPELRVVLVFGYNCCKVGASNYLQQVVSTFSDMNIILAGGQV

SEQ ID NO: 2615 - protein, 255 aa, Homo sapiens
MRLGPRTAALGLLLLCAAAAGAGKAEELHYPLGERRSDYDREALLGVQEDVDEYVKLGHEEQQKRLQAIIKKIDLDSDGFLTESELSSWIQMSFKHYAMQEAKQQFVEYDKNSDDTVTWDEYNIQMYDRVIDFDENTALDDAEEESFRKLHLKDKKRFEKANQDSGPGLSLEEFIAFEHPEEVDYMTEFVIQEALEEHDKNGDGFVSLEEFLGDYRWDPTANEDPEWILVEKDRFVNDYDKDNDGRLDPQELLPW

SEQ ID NO: 2616 - protein, 255 aa, Homo sapiens
MSFIPVAEDSDFPIHNLPYGVFSTRGDPRPRIGVAIGDQILDLSIIKHLFTGPVLSKHQDVFNQPTLNSFMGLGQAAWKEARVFLQNLLSVSQARLRDDTELRKCAFISQASATMHLPATIGDYTDFYSSRQHATNVGIMFRDKENALMPNWLHLPVGYHGRASSVVVSGTPIRRPMGQMKPDDSKPPVYGACKLLDMELEMAFFVGPGNRLGEPIPISKAHEHIFGMVLMNDWSARDIQKWEYVPLGPFLGKSF

SEQ ID NO: 2617 - protein, 255 aa, Homo sapiens
MESHSRAGKSRKSAKFRSISRSLMLCNAKTSDDGSSPDEKYPDPFEISLAQGKEGIFHSSVQLADTSEAGPSSVPDLALASEAAQLQAAGNDRGKTCRRIFFMKESSTASSREKPGKLEAQSSNFLFPKACHQRARSNSTSVNPYCTREIDFPMTKKSAAPTDRQPYSLCSNRKSLSQQLDCPAGKAAGTSRPTRSLSTAQLVQPSGGLQASVISNIVLMKGQAKGLGFSIVGGKDSIYGPIGIYVKTIFAGGAA

SEQ ID NO: 2618 - protein, 255 aa, Homo sapiens
MNAMLETPELPAVFDGVKLAAVAAVLYVIVRCLNLKSPTAPPDLYFQDSGLSRFLLKSCPLLTKEYIPPLIWGKSGHIQTALYGKMGRVRSPHPYGHRKFITMSDGATSTFDLFEPLAEHCVGDDITMVICPGIANHSEKQYIRTFVDYAQKNGYRCAVLNHLGALPNIELTSPRMFTYGCTWEFGAMVNYIKKTYPLTQLVVVGFSLGGNIVCKYLGETQANQEKVLCCVSVCQGYSALRAQETFMQWDQCRRF

SEQ ID NO: 2619 - protein, 255 aa, Homo sapiens
MQGKKPGGSSGGGRSGELQGDEAQRNKKKKKKVSCFSNIKIFLVSECALMLAQGTVGAYLVSVLTTLERRFNLQSADVGVIASSFEIGNLALILFVSYFGARGHRPRLIGCGGIVMALGALLSALPEFLTHQYKYEAGEIRWGAEGRDVCAANGSGGDEGPDPDLICRNRTATNMMYLLLIGAQVLLGIGATPVQPLGVSYIDDHVRRKDSSLYIGILFTMLVFGPACGFILGSFCTKIYVDAVFIDTSNLDITP

SEQ ID NO: 2620 - protein, 255 aa, Homo sapiens
MGILDIEVWGKDNKKHEERLGTCKVDISALPLKQANCLELPLDSCLGALLMLVTLTPCAGVSVSDLCVCPLADLSERKQITQRYCLQNSLKDVKDVGILQVKVLKAADLLAADFSGKSDPFCLLELGNDRLQTHTVYKNLNPEWNKVFTFPIKDIHDVLEVTVFDEDGDKPPDFLGKVAIPLLSIRDGQPNCYVLKNKDLEQAFKGVIYLEMDLIYNPVKASIRTFTPREKRFVEDSRKLSKKILSRDVDRVKRI

SEQ ID NO: 2621 - protein, 255 aa, Homo sapiens
MGRKKIQITRIMDERNRQTLRKKGLNGCESPDADDYFEHSPLSEDRFSKLNEDSDFIFKRGPPGLPPQNFSMSVTVPVTSPNALSYTNPGSSLVSPSLAASSTLTDSSMLSPPQTTLHRNVSPGAPQRPPSTGNAGGMLSTTDLTVPNGAGSSPVGNGFVNSRASPNLIGATGANSLGKVMPTKSPPPPGGGNLGMNSRKPDLRVVIPPSSKGMMPPLNTQRISSSQATQPLATPVVSVTTPSLPPQGLVYSAMP

SEQ ID NO: 2622 - protein, 255 aa, Homo sapiens
MSQGRGKYDFYIGLGLAMSSSIFIGGSFILKKKGLLRLARKGSMRAGQGGHAYLKEWLWWAGLLSMGAGEVANFAAYAFAPATLVTPLGALSVLVSAILSSYFLNERLNLHGKIGCLLSILGSTVMVIHAPKEEEIETLNEMSHKLGDPGFVVFATLVVIVALILIFVVGPRHGQTNILVYITICSVIGAFSVSCVKGLGIAIKELFAGKPVLRHPLAWILLLSLIVCVSTQINYLNRALDIFNTSIVTPIYYVF

SEQ ID NO: 2623 - protein, 255 aa, Homo sapiens
MPSESFCLAAQARLDSKWLKTDIQLAFTRDGLCGLWNEMVKDGEIVYTGTESTQNGELPPRKDDSVEPSGTKKEDLNDKEKKDEEETPAPIYRAKSILDSWVWGKQPDVNELKECLSVLVKEQQALAVQSATTTLSALRLKQRLVILERYFIALNRTVFQENVKVKWKSSGISLPPVDKKSSRPAGKGVEGLARVGSRAALSFAFAFLRRAWRSGEDADLCSELLQESLDALRALPEASLFDESTVSSVWLEVVE

SEQ ID NO: 2624 - protein, 255 aa, Homo sapiens
MFSLKPPKPTFRSYLLPPPQTDDKINSEPKIKKLEPVLLPGEIVVNEVNFVRKCIATDTSQYDLWGKLICSNFKISFITDDPMPLQKFHYRNLLLGEHDVPLTCIEQIVTVNDHKRKQKVLGPNQKLKFNPTELIIYCKDFRIVRFRFDESGPESAKKVCLAIAHYSQPTDLQLLFAFEYVGKKYHNSANKINGIPSGDGGGGGGGGNGAGGGSSQKTPLFETYSDWDREIKRTGASGWRVCSINEGYMISTCLP

SEQ ID NO: 2625 - protein, 242 aa, Homo sapiens
MAAALWGFFPVLLLLLLSGDVQSSEVPGAAAEGSGGSGVGIGDRFKIEGRAVVPGVKPQDWISAARVLVDGEEHVGFLKTDGSFVVHDIPSGSYVVEVVSPAYRFDPVRVDITSKGKMRARYVNYIKTSEVVRLPYPLQMKSSGPPSYFIKRESWGWTDFLMNPMVMMMVLPLLIFVLLPKVVNTSDPDMRREMEQSMNMLNSNHELPDVSEFMTRLFSSKSSGKSSSGSSKTGKSGAGKRR

SEQ ID NO: 2626 - protein, 255 aa, Homo sapiens
MPHFTVTKVEDPEEGAAASISQEPSLADIKARIQDSDEPDLSQNSITGEHSQLLDDGHKKARNAYLNNSNYEEGDEYFDKNLALFEEEMDTRPKVSSLLNRMANYTNLTQGAKEHEEAENITEGKKKPTKTPQMGTFMGVYLPCLQNIFGVILFLRLTWVVGTAGVLQAFAIVLICCCCTMLTAISMSAIATNGVVPAGGSYFMISRALGPEFGGAVGLCFYLGTTFAAAMYILGAIEIFLVYIVPRAAIFHSDD

SEQ ID NO: 2627 - protein, 255 aa, Homo sapiens
MSQGSPGDWAPLDPTPGPPASPNPFVHELHLSRLQRVKFCLLGALLAPIRVLLAFIVLFLLWPFAWLQVAGLSEEQLQEPITGWRKTVCHNGVLGLSRLLFFLLGFLRIRVRGQRASRLQAPVLVAAPHSTFFDPIVLLPCDLPKVVSRAENLSVPVIGALLRFNQAILVSRHDPASRRRVVEEVRRRATSGGKWPQVLFFPEGTCSNKKALLKFKPGAFIAGVPVQPVLIRYPNSLDTTSWAWRGPGVLKVLWL

SEQ ID NO: 2628 - protein, 255 aa, Homo sapiens
MASELGARDDGGCTELAKPLYLQYLERALRLDHFLRQTSAIFNRNISSDDSEDGLDDSNPLLPQSGDPLIQVKEEPPNSLLGETSGAGSSGMLNTYSLNGVLQSESKCDKGNLYNFSKLKKSRKWLKSILLSDESSEADSQSEDDDEEELNLSREELHNMLRLHKYKKLHQNKYSKDKELQQYQYYSAGLLSTYDPFYEQQRHLLGPKKKKFKEEKKLKAKLKKVKKKRRRDEELSSEESPRRHHHQTKVFAKFS

SEQ ID NO: 2629 - protein, 229 aa, Homo sapiens
MAAQPLRHRSRCATPPRGDFCGGTERAIDQASFTTSMEWDTQVVKGSSPLGPAGLGAEEPAAGPQLPSWLQPERCAVFQCAQCHAVLADSVHLAWDLSRSLGAVVFSRVTNNVVLEAPFLVGIEGSLKGSTYNLLFCGSCGIPVGFHLYSTHAALAALRGHFCLSSDKMVCYLLKTKAIVNASEMDIQNVPLSEKIAELKEKIVLTHNRLKSLMKILSEVTPDQSKPEN

SEQ ID NO: 2630 - protein, 255 aa, Homo sapiens
MPVGRIECPSSPSFPRDISHECRVCGVTEVGLSAYAKHISGQLHKDNVDAQEREDDGKGEEEEEDYFDKELIQLIKQRKEQSRQDEPSNSNQEINSDDRRPQWRREDRIPYQDRESYSQPAWHHRGPPQRDWKWEKDGFNNTRKNSFPHSLRNGGGPRGRSGWHKGVAGGSSTWFHNHSNSGGGWLSNSGAVDWNHNGTGRNSSWLSEGTGGFSSWHMNNSNGNWKSSVRSTNNWNYSGPGDKFQPGRNRNSNCQ

SEQ ID NO: 2631 - protein, 255 aa, Homo sapiens
MAAVLESLLREEVSVAAVVRWIARSTQGSEDNAGEAAALSSLRALRKEFVPFLLNFLREQSSRVLPQGPPTPAKTPGASAALPGRPGGPPRGSRGARSQLFPPTEAQSTAAEAPLARRGGRRRGPGPARERGGRGLEEGVSGESLPGAGGRRLRGSGSPSRPSLTLSDPPNLSNLEEFPPVGSVPPGPTGTKPSRRINPTPVSEERSLSKPKTCFTSPPISCVPSSQPSALDTSPWGLGLPPGCRSLQEEREMLR

SEQ ID NO: 2632 - protein, 255 aa, Homo sapiens
MAAEEGVASAASAGGSWGTAAMGRVLPMLLVPVPAEAMGQLGSRAQLRTQPEALGSLTAAGSLQVLSLTPGSRGGGRCCLEGPFWHFLWEDSRNSSTPTEKPKLLALGENYELLIYEFNLKDGRCDATILYSCSREALQKLIDDQDISISLLSLRILSFHNNTSLLFINKCVILHIIFPERDAAIRVLNCFTLPLPAQAVDMIIDTQLCRGILFVLSSLGWIYIFDVVDGTYVAHVDLALHKEDMCNEQQQEPAK

SEQ ID NO: 2633 - protein, 255 aa, Homo sapiens
MGPQRRLSPAGAALLWGFLLQLTAAQEAILHASGNGTTKDYCMLYNPYWTALPSTLENATSISLMNLTSTPLCNLSDIPPVGIKSKAVVVPWGSCHFLEKARIAQKGGAEAMLVVNNSVLFPPSGNRSEFPDVKILIAFISYKDFRDMNQTLGDNITVKMYSPSWPNFDYTMVVIFVIAVFTVALGGYWSGLVELENLKAVTTEDREMRKKKEEYLTFSPLTVVIFVVICCVMMVLLYFFYKWLVYVMIAIFCIA

SEQ ID NO: 2634 - protein, 255 aa, Homo sapiens
MATEGLHENETLASLKSEAESLKGKLEEERAKLHDVELHQVAERVEALGQFVMKTRRTLKGHGNKVLCMDWCKDKRRIVSSSQDGKVIVWDSFTTNKEHAVTMPCTWVMACAYAPSGCAIACGGLDNKCSVYPLTFDKNENMAAKKKSVAMHTNYLSACSFTNSDMQILTASGDGTCALWDVESGQLLQSFHGHGADVLCLDLAPSETGNTFVSGGCDKKAMVWDMRSGQCVQAFETHESDINSVRYYPSGDAFA

SEQ ID NO: 2635 - protein, 255 aa, Homo sapiens
MAASELYTKFARVWIPDPEEVWKSAELLKDYKPGDKVLLLHLEEGKDLEYHLDPKTKELPHLRNPDILVGENDLTALSYLHEPAVLHNLRVRFIDSKLIYTYCGIVLVAINPYEQLPIYGEDIINAYSGQNMGDMDPHIFAVAEEAYKQMARDERNQSIIVSGESGAGKTVSAKYAMRYFATVSGSASEANVEEKVLASNPIMESIGNAKTTRNDNSSRFGKYIEIGFDKRYRIIGANMRTYLLEKSRVVFQAEE

SEQ ID NO: 2636 - protein, 112 aa, Homo sapiens
MSAEVPEAASAEEQKEMEDKVTSPEKAEEAKLKARYPHLGQKPGGSDFLRKRLQKGQKYFDSGDYNMAKAKMKNKQLPTAAPDKTEVTGDHIPTPQDLPQRKPSLVASKLAG

SEQ ID NO: 2637 - protein, 221 aa, Homo sapiens
MSDGDYDYLIKFLALGDSGVGKTSVLYQYTDGKFNSKFITTVGIDFREKRVVYRASGPDGATGRGQRIHLQLWDTAGQERFRSLTTAFFRDAMGFLLLFDLTNEQSFLNVRNWISQLQMHAYCENPDIVLCGNKSDLEDQRVVKEEEAIALAEKYGIPYFETSAANGTNISQAIEMLLDLIMKRMERCVDKSWIPEGVVRSNGHASTDQLSEEKEKGACGC

SEQ ID NO: 2638 - protein, 255 aa, Homo sapiens
MSENSSDSDSSCGWTVISHEGSDIEMLNSVTPTDSCEPAPECSSLEQEELQALQIEQGESSQNGTVLMEETAYPALEETSSTIEAEEQKIPEDSIYIGTASDDSDIVTLEPPKLEEIGNQEVVIVEEAQSSEDFNMGSSSSSQYTFCQPETVFSSQPSDDESSSDETSNQPSPAFRRRRARKKTVSASESEDRLVAEQETEPSKELSKRQFSSGLNKCVILALVIAISMGFGHFYGTIQIQKRQQLVRKIHEDEL

SEQ ID NO: 2639 - protein, 188 aa, Homo sapiens
MEDERSFSDICGGRLALQRRYYSPSCREFCLSCPRLSLRSLTAVTCTVWLAAYGLFTLCENSMILSAAIFITLLGLLGYLHFVKIDQETLLIIDSLGIQMTSSYASGKESTTFIEMGKVKDIVINEAIYMQKVIYYLCILLKDPVEPHGISQVVPVFQSAKPRLDCLIEVYRSCQEILAHQKATSTSP

SEQ ID NO: 2640 - protein, 255 aa, Homo sapiens
MPRRSLHAAAVLLLVILKEQPSSPAPVNGSKWTYFGPDGENSWSKKYPSCGGLLQSPIDLHSDILQYDASLTPLEFQGYNLSANKQFLLTNNGHSVKLNLPSDMHIQGLQSRYSATQLHLHWGNPNDPHGSEHTVSGQHFAAELHIVHYNSDLYPDASTASNKSEGLAVLAVLIEMGSFNPSYDKIFSHLQHVKYKGQEAFVPGFNIEELLPERTAEYYRYRGSLTTPPCNPTVLWTVFRNPVQISQEQLLALET

SEQ ID NO: 2641 - protein, 160 aa, Homo sapiens
MQRVSGLLSWTLSRVLWLSGLSEPGAARQPRIMEEKALEVYDLIRTIRDPEKPNTLEELEVVSESCVEVQEINEEEYLVIIRFTPTVPHCSLATLIGLCLRVKLQRCLPFKHKLEIYISEGTHSTEEDINKQINDKERVAAAMENPNLREIVEQCVLEPD

SEQ ID NO: 2642 - protein, 65 aa, Homo sapiens
MVRTKADSVPGTYRKVVAARAPRKVLGSSTSATNSTSVSSRKEHVLCNLITQMMKKNRTFSFIFE

SEQ ID NO: 2643 - protein, 255 aa, Homo sapiens
MYPQGRHPAPHQPGQPGFKFTVAESCDRIKDEFQFLQAQYHSLKVEYDKLANEKTEMQRHYVMYYEMSYGLNIEMHKQTEIAKRLNTILAQIMPFLSQEHQQQVAQAVERAKQVTMTELNAIIGQQQLQAQHLSHATHGPPVQLPPHPSGLQPPGIPPVTGSSSGLLALGALGSQAHLTVKDEKNHHELDHRERESSANNSVSPSESLRASEKHRGSADYSMEAKKRKAEEKDSLSRYDSDGDKSDDLVVDVSNE

SEQ ID NO: 2644 - protein, 255 aa, Homo sapiens
MDIKGQFWNDDDSEGDNESEEFLYGVQGSCAADLYRHPQLDADIEAVKEIYSENSVSIREYGTIDDVDIDLHINISFLDEEVSTAWKVLRTEPIVLRLRFSLSQYLDGPEPSIEVFQPSNKEGFGLGLQLKKILGMFTSQQWKHLSNDFLKTQQEKRHSWFKASGTIKKFRAGLSIFSPIPKSPSFPIIQDSMLKGKLGVPELRVGRLMNRSISCTMKNPKVEVFGYPPSPQAGLLCPQHVGLPPPARTSPLVSG

SEQ ID NO: 2645 - protein, 255 aa, Homo sapiens
MSGSSLPSALALSLLLVSGSLLPGPGAAQNEPRIVTSEEVIIRDSPVLPVTLQCNLTSSSHTLTYSYWTKNGVELSATRKNASNMEYRINKPRAEDSGEYHCVYHFVSAPKANATIEVKAAPDITGHKRSENKNEGQDATMYCKSVGYPHPDWIWRKKENGMPMDIVNTSGRFFIINKENYTELNIVNLQITEDPGEYECNATNAIGSASVVTVLRVRSHLAPLWPFLGILAEIIILVVIIVVYEKRKRPDEVPD

SEQ ID NO: 2646 - protein, 1017 aa, Homo sapiens [sequence omitted]

SEQ ID NO: 2647 - protein, 184 aa, Homo sapiens
MVRKLKFHEQKLLKQVDFLNWEVTDHNLHELRVLRRYRLQRREDYTRYNQLSRAVRELARRLRDLPERDQFRVRASAALLDKLYALGLVPTRGSLELCDFVTASSFCRRRLPTVLLKLRMAQHLQAAVAFVEQGHVRVGPDVVTDPAFLVTRSMEDFVTWVDSSKIKRHVLEYNEERDDFDLEA

SEQ ID NO: 2648 - protein, 179 aa, Homo sapiens
MARSRLTATSVSQVQVIAHSEYQKSKRISIFLSMQDEIETEEIIKDIFQRGKICFIPRYRFQSNHMDMVRIESPEEISLLPKTSWNIPQPGEGDVREEALSTGGLDLIFMPGLGFDKHGNRLGRGKGYYDAYLKRCLQHQEVKPYTLALAFKEQICLQVPVNENDMKVDEVLYEDSSTA

SEQ ID NO: 2649 - protein, 79 aa, Homo sapiens
MARSRLTATSVSQVQENGFVKKLEPKSGWMTFLEVTGKICEMLFCPEAILLTRKDTPYCETGLIFLTLTKTIANTYFYF

SEQ ID NO: 2650 - protein, 255 aa, Homo sapiens
MKTSKASQRYRGIRRNASQCYLYQESLLLSNLDDSFSADETGDSNDPEQIFQNIQFQKDLMANIRCRPWTMGQKLRALRQAKNIVLKFEGRLTRTRGYQAAGAELWRKFARLACNFVVIFIPWEMRIKKIESHFGSGVASYFIFLRWLFGINIVLTIMTGAFIVIPELIAGQPFGSTARKTIPKEQVSSAQDLDTVWSLGGYLQYSVLFYGYYGRERKIGRAGYRLPLAYFLVGMAVFAYSFIILLKKMAKNSRT

SEQ ID NO: 2651 - protein, 255 aa, Homo sapiens
MSAAPAYSEDKGGSAGPGEPEYGHDPASGGIFSSDYKRHDDLKEMLDTNKDSLKLEAMKRIVAMIARGKNASDLFPAVVKNVACKNIEVKKLVYVYLVRYAEEQQDLALLSISTFQRGLKDPNQLIRASALRVLSSIRVPIIVPIMMLAIKEAASDMSPYVRKTAAHAIPKLYSLDSDQKDQLIEVIEKLLADKTTLVAGSVVMAFEEVCPERIDLIHKNYRKLCNLLIDVEEWGQVVIISMLTRYARTQFLSPT

SEQ ID NO: 2652 - protein, 153 aa, Homo sapiens
MLRLRSGLRHLRATPNTRGSARLLCAEMPKKAGATTKGKSQSKEPERPLPPLGPVAVDPKGCVTIAIHAKPGSKQNAVTDLTAEAVNVAIAAPPSEGEANAELCRYLSKVLELRKSDVVLDKGGKSREKVVKLLASTTPEEILEKLKKEAKKT

SEQ ID NO: 2653 - protein, 255 aa, Homo sapiens
MDPGDDWLVESLRLYQDFYAFDLSGATRVLEWIDDKGVFVAGYESLKKNEILHLKLPLRLSVKENKGLFPERDFKVRHGGFSDRSIFDLKHVPHTRLLVTSGLPGCYLQVWQVAEDSDVIKAVSTIAVHEKEESLWPRVAVFSTLAPGVLHGARLRSLQVVDLESRKTTYTSDVSDSEELSSLQVLDADTFAFCCASGRLGLVDTRQKWAPLENRSPGPGSGGERWCAEVGSWGQGPGPSIASLGSDGRLCLLDP

SEQ ID NO: 2654 - protein, 255 aa, Homo sapiens
MDVSLCPAKCSFWRIFLLGSVWLDYVGSVLACPANCVCSKTEINCRRPDDGNLFPLLEGQDSGNSNGNASINITDISRNITSIHIENWRSLHTLNAVDMELYTGLQKLTIKNSGLRSIQPRAFAKNPHLRYINLSSNRLTTLSWQLFQTLSLRELQLEQNFFNCSCDIRWMQLWQEQGEAKLNSQNLYCINADGSQLPLFRMNISQCDLPEISVSHVNLTVREGDNAVITCNGSGSPLPDVDWIVTGLQSINTHQ

SEQ ID NO: 2655 - protein, 255 aa, Homo sapiens
MVGQILKRDVIMDHHVSTIKPRRIQNQNVIHRLERRRISSGKAGTHWHQVRVFHQNVFPNFTVVNVEKPPCFLRKFSPDGRYFIAFSSDQTSLEIYEYQGCQAAEDLLQGYEGEILSNGNDQRSVNIRGRLFERFFVLLHITNVAANGEHLNRECSLFTDDCRCVIVGSAAYLPDEPHPPFFEVYRNSESVTPNPRSPLEDYSLHIIDLHTGRLCDTRTFKCDKVVLSHNQGLYLYKNILAILSVQQQTIHVFQV

SEQ ID NO: 2656 - protein, 247 aa, Homo sapiens
MAGGVLPLRGLRALCRVLLFLSQFCILSGGEQSQALAQSIKDPGPTRTFTVVPRAAESTEIPPYVMKCPSNGLCSRLPADCIDCTTNFSCTYGKPVTFDCAVKPSVTCVDQDFKSQKNFIINMTCRFCWQLPETDYECTNSTSCMTVSCPRQRYPANCTVRDHVHCLGNRTFPKMLYCNWTGGYKWSTALALSITLGGFGADRFYLGQWREGLGKLFSFGGLGIWTLIDVLLIGVGYVGPADGSLYI

SEQ ID NO: 2657 - protein, 255 aa, Homo sapiens
MARAWQHPFLNVFRHFRVDEWKRSAKQGDVAVVTDKTLKGAVYRIRGSVSAANYIQLPKSSTQSLGLTGRYLYVLFRPLPSKHFVIHLDVSSKDNQVIRVSFSNLFKEFKSTATWLQFPLVLEARTPQRDLVGLAPSGARWTCLQLDLQDVLLVYLNRCYGHLKSIRLCASLLVRNLYTSDLCFEPAISGAQWAKLPVTPMPREMAFPVPKGESWHDRYIHVRFPSESLKVPSKPIEKSCSPPEAVLLGPGPQPL

SEQ ID NO: 2658 - protein, 255 aa, Homo sapiens
MRRDVRILLLGEAQVGKTSLILSLVGEEFPEEVPPRAEEITIPADVTPEKVPTHIVDYSEAEQTDEELREEIHKANVVCVVYDVSEEATIEKIRTKWIPLVNGGTTQGPRVPIILVGNKSDLRSGSSMEAVLPIMSQFPEIETCVECSAKNLRNISELFYYAQKAVLHPTAPLYDPEAKQLRPACAQALTRIFRLSDQDLDQALSDEELNAFQKSCFGHPLAPQALEDVKTVVCRNVAGGVREDRLTLDGFLFLN

SEQ ID NO: 2659 - protein, 226 aa, Homo sapiens
MTVQRLVAAAVLVALVSLILNNVAAFTSNWVCQTLEDGRRRSVGLWRSCWLVDRTRGGPSPGARAGQVDAHDCEALGWGSEAAGFQESRGTVKLQFDMMRACNLVATAALTAGQLTFLLGLVGLPLLSPDAPCWEEAMAAAFQLASFVLVIGLVTFYRIGPYTNLSWSCYLNIGACLLATLAAAMLIWNILHKREDCMAPRVIVISRSLTARFRRGLDNDYVESPC

SEQ ID NO: 2660 - protein, 255 aa, Homo sapiens
MTVKLGDGGSGEDGLKKLGKRAADEESLEGEGAGGADAAEESSGTKRDEKTPRAGADGPPAPPGAPQAPSPPQGSPQDQHHFLRSSVRPQSKRPRKDPPSAVGSGNAGGSGPRGKGAEGGGSSSGNVSGVAPAAPAGGSRSSSRNLGSSGGEKEEGKKVRRQWESWSTEDKNTFFEGLYEHGKDFEAIQNNIALKYKKKGKPASMVKNKEQVRHFYYRTWHKITKYIDFDHVFSRGLKKSSQELYGLICYGELRK

SEQ ID NO: 2661 - protein, 255 aa, Homo sapiens
MMEIQMDEGGGVVVYQDDYCSGSVMSERVSGLAGSIYREFERLIHCYDEEVVKELMPLVVNVLENLDSVLSENQEHEVELELLREDNEQLLTQYEREKALRRQAEEKFIEFEDALEQEKKELQIQVEHYEFQTRQLELKAKNYADQISRLEERESEMKKEYNALHQRHTEMIQTYVEHIERSKMQQVGGNSQTESSLPGRRKERPTSLNVFPLADGTVRAQIGGKLVPAGDHWHLSDLGQLQSSSSYQCPQDEMS

SEQ ID NO: 2662 - protein, 255 aa, Homo sapiens
MAETAAGVGRFKTNYAVERKIEPFYKGGKAQLDQTGQHLFCVCGTRVNILEVASGAVLRSLEQEDQEDITAFDLSPDNEVLVTASRALLLAQWAWQEGSVTRLWKAIHTAPVATMAFDPTSTLLATGGCDGAVRVWDIVRHYGTHHFRGSPGVVHLVAFHPDPTRLLLFSSATDAAIRVWSLQDRSCLAVLTAHYSAVTSLAFSADGHTMLSSGRDKICIIWDLQSCQATRTVPVFESVEAAVLLPEEPVSQLGV

SEQ ID NO: 2663 - protein, 255 aa, Homo sapiens
MPPAAPARLALALGLGLWLGALAGGPGRGCGPCEPPCLCGPAPGAACRVNCSGRGLRTLGPALRIPADATALDVSHNLLRALDVGLLANLSALAELDISNNKISTLEEGIFANLFNLSEINLSGNPFECDCGLAWLPRWAEEQQVRVVQPEAATCAGPGSLAGQPLLGIPLLDSGCGEEYVACLPDNSSGTVAAVSFSAAHEGLLQPEACSAFCFSTGQGLAALSEQGWCLCGAAQPSSASFACLSLCSGPPPPP

SEQ ID NO: 2664 - protein, 234 aa, Homo sapiens
MAENHCELLSPARGGIGAGLGGGLCRRCSAGLGALAQRPGSVSKWVRLNVGGTYFLTTRQTLCRDPKSFLYRLCQADPDLDSDKDETGAYLIDRDPTYFGPVLNYLRHGKLVINKDLAEEGVLEEAEFYNITSLIKLVKDKIRERDSKTSQVPVKHVYRVLQCQEEELTQMVSTMSDGWKFEQLVSIGSSYNYGNEDQAEFLCVVSKELHNTPYGTASEPSEKAKILQERGSRM

SEQ ID NO: 2665 - protein, 255 aa, Homo sapiens
MSFRDLRNFTEMMRALGYPRHISMENFRTPNFGLVSEVLLWLVKRYEPQTDIPPDVDTEQDRVFFIKAIAQFMATKAHIKLNTKKLYQADGYAVKELLKITSVLYNAMKTKGMEGSEIVEEDVNKFKFDLGSKIADLKAARQLASEITSKGASLYDLLGMEVELREMRTEAIARPLEINETEKVMRIAIKEILTQVQKTKDLLNNVASDEANLEAKIEKRKLELERNRKRLETLQSVRPCFMDEYEKTEEELQKQ

SEQ ID NO: 2666 - protein, 255 aa, Homo sapiens
MRGMKLLGALLALAALLQGAVSLKIAAFNIQTFGETKMSNATLVSYIVQILSRYDIALVQEVRDSHLTAVGKLLDNLNQDAPDTYHYVVSEPLGRNSYKERYLFVYRPDQVSAVDSYYYDDGCEPCGNDTFNREPAIVRFFSRFTEVREFAIVPLHAAPGDAVAEIDALYDVYLDVQEKWGLEDVMLMGDFNAGCSYVRPSQWSSIRLWTSPTFQWLIPDSADTTATPTHCAYDRIVVAGMLLRGAVVPDSALPF

SEQ ID NO: 2667 - protein, 255 aa, Homo sapiens
MAARCSTRWLLVVVGTPRLPAISGRGARPPREGVVGAWLSRKLSVPAFASSLTSCGPRALLTLRPGVSLTGTKHNPFICTASFHTSAPLAKEDYYQILGVPRNASQKEIKKAYYQLAKKYHPDTNKDDPKAKEKFSQLAEAYEVLSDEVKRKQYDAYGSAGFDPGASGSQHSYWKGGPTVDPEELFRKIFGEFSSSSFGDFQTVFDQPQEYFMELTFNQAAKGVNKEFTVNIMDTCERCNGKGNEPGTKVQHCHY

SEQ ID NO: 2668 - protein, 255 aa, Homo sapiens
MEEYEKFCEKSLARIQEASLSTESFLPAQSESISLIRFHGVAILSPLLNIEKRKEMQQEKQKALDVEARKQVNRKKALLTRVQEILDNVQVRKAPNASDFDQWEMETVYSNSEVRNLNVPATFPNSFPSHTEHSTAAKLDKIAGILPLDNEDQCKTDGIDLARDSEGFNSPKQCDSSNISHVENEAFPKTSSATPQETLISDGPFSVNEQQDLPLLAEVIPDPYVMSLQNLMKKSKEYIEREQSRRSLRGSMNRI

SEQ ID NO: 2669 - protein, 255 aa, Homo sapiens
MAPAGVVTRAVRSGELPLTSMASAENEACAVRSVACPSQAWRLQKVLCGRCGAASCPSQTWRPRGAGSGGVRMGSRADGPRTSGHVTGKMAVFPWHSRNRNYKAEFASCRLEAVPLEFGDYHPLKPITVTESKTKKVNRKGSTSSTSSSSSSSVVDPLSSVLDGTDPLSMFAATADPAALAAAMDSSRRKRDRDDNSVVGSDFEPWTNKRGEILARYTTTEKLSINLFMGSEKGKAGTATLAMSEKVRTRLEELD

SEQ ID NO: 2670 - protein, 122 aa, Homo sapiens
MTTATRQEVLGLYRSIFRLARKWQATSGQMEDTIKEKQYILNEARTLFRKNKNLTDTDLIKQCIDECTARIEIGLHYKIPYPRPIHLPPMGLTPLRGRGLRSQEKLRKLSKPVYLRSHDEVS

SEQ ID NO: 2671 - protein, 255 aa, Homo sapiens
MRLLAGWLCLSLASVWLARRMWTLRSPLTRSLYVNMTSGPGGPAAAAGGRKENHQWYVCNREKLCESLQAVFVQSYLDQGTQIFLNNSIEKSGWLFIQLYHSFVSSVFSLFMSRTSINGLLGRGSMFVFSPDQFQRLLKINPDWKTHRLLDLGAGDGEVTKIMSPHFEEIYATELSETMIWQLQKKKYRVLGINEWQNTGFQYDVISCLNLLDRCDQPLTLLKDIRSVLEPTRGRVILALVLPFHPYVENGGKWE

SEQ ID NO: 2672 - protein, 255 aa, Homo sapiens
MADEDLIFRLEGVDGGQSPRAGHDGDSDGDSDDEEGYFICPITDDPSSNQNVNSKVNKYYSNLTKSERYSSSGSPANSFHFKEAWKHAIQKAKHMPDPWAEFHLEDIATERATRHRYNAVTGEWLDDEVLIKMASQPFGRGAMRECFRTKKLSNFLHAQQWKGASNYVAKRYIEPVDRDVYFEDVRLQMEAKLWGEEYNRHKPPKQVDIMQMCIIELKDRPGKPLFHLEHYIEGKYIKYNSNSGFVRDDNIRLTP

SEQ ID NO: 2673 - protein, 255 aa, Homo sapiens
MANEEDDPVVQEIDVYLAKSLAEKLYLFQYPVRPASMTYDDIPHLSAKIKPKQQKVELEMAIDTLNPNYCRSKGEQIALNVDGACADETSTYSSKLMDKQTFCSSQTTSNTSRYAAALYRQGELHLTPLHGILQLRPSFSYLDKADAKHREREAANEAGDSSQDEAEDDVKQITVRFSRPESEQARQRRVQSYEFLQKKHAEEPWVHLHYYGLRDSRSEHERQYLLCPGSSGVENTELVKSPSEYLMMLMPPSQE

SEQ ID NO: 2674 - protein, 255 aa, Homo sapiens
MSAAVTAGKLARAPADPGKAGVPGVAAPGAPAAAPPAKEIPEVLVDPRSRRRYVRGRFLGKGGFAKCFEISDADTKEVFAGKIVPKSLLLKPHQREKMSMEISIHRSLAHQHVVGFHGFFEDNDFVFVVLELCRRRSLLELHKRRKALTEPEARYYLRQIVLGCQYLHRNRVIHRDLKLGNLFLNEDLEVKIGDFGLATKVEYDGERKKTLCGTPNYIAPEVLSKKGHSFEVDVWSIGCIMYTLLVGKPPFETSC

SEQ ID NO: 2675 - protein, 255 aa, Homo sapiens
MADPAAGPPPSEGEESTVRFARKGALRQKNVHEVKNHKFTARFFKQPTFCSHCTDFIWGFGKQGFQCQVCCFVVHKRCHEFVTFSCPGADKGPASDDPRSKHKFKIHTYSSPTFCDHCGSLLYGLIHQGMKCDTCMMNVHKRCVMNVPSLCGTDHTERRGRIYIQAHIDRDVLIVLVRDAKNLVPMDPNGLSDPYVKLKLIPDPKSESKQKTKTIKCSLNPEWNETFRFQLKESDKDRRLSVEIWDWDLTSRNDF

SEQ ID NO: 2676 - protein, 255 aa, Homo sapiens
MSCRCIFLMKHGERVGWPVGVSMPRGWAAPLLLLLLQGGWGCPDLVCYTDYLQTVICILEMWNLHPSTLTLTWQDQYEELKDEATSCSLHRSAHNATHATYTCHMDVFHFMADDIFSVNITDQSGNYSQECGSFLLAESIKPAPPFNVTVTFSGQYNISWRSDYEDPAFYMLKGKLQYELQYRNRGDPWAVSPRRKLISVDSRSVSLLPLEFRKDSSYELQVRAGPMPGSSYQGTWSEWSDPVIFQTQSEELKEG

SEQ ID NO: 2677 - protein, 255 aa, Homo sapiens
MELIQDTSRPPLEYVKGVPLIKYFAEALGPLQSFQARPDDLLISTYPKSGTTWVSQILDMIYQGGDLEKCHRAPIFMRVPFLEFKAPGIPSGMETLKDTPAPRLLKTHLPLALLPQTLLDQKVKVVYVARNAKDVAVSYYHFYHMAKVHPEPGTWDSFLEKFMVGEVSYGSWYQHVQEWWELSRTHPVLYLFYEDMKENPKREIQKILEFVGRSLPEETVDFVVQHTSFKEMKKNPMTNYTTVPQEFMDHSISPF

SEQ ID NO: 2678 - protein, 255 aa, Homo sapiens
MLKPQPLQQPSQPQQPPPTQQAVARRPPGGTSPPNGGLPGPLATSAAPPGPPAAASPCLGPVAAAGSGLRRGAEGILAPQPPPPQQHQERPGAAAIGSARGQSTGKGPPQSPVFEGVYNNSRMLHFLTAVVGSTCDVKVKNGTTYEGIFKTLSSKFELAVDAVHRKASEPAGGPRREDIVDTMVFKPSDVMLVHFRNVDFNYATKDKFTDSAIAMNSKVNGEHKEKVLQRWEGGDSNSDDYDLESDMSNGWDPNE

SEQ ID NO: 2679 - protein, 255 aa, Homo sapiens
MEEAILVPCVLGLLLLPILAMLMALCVHCHRLPGSYDSTSSDSLYPRGIQFKRPHTVAPWPPAYPPVTSYPPLSQPDLLPIPRSPQPLGGSHRTPSSRRDSDGANSVASYENEGASGIRGAQAGWGVWGPSWTRLTPVSLPPEPACEDADEDEDDYHNPGYLVVLPDSTPATSTAAPSAPALSTPGIRDSAFSMESIDDYVNVPESGESAEASLDGSREYVNVSQELHPGAAKTEPAALSSQEAEEVEEEGAPDY

SEQ ID NO: 2680 - protein, 255 aa, Homo sapiens
MDSCSLEIANWRNHQETLKYQFDAFYGERSTQQDIYAGSVQPILRHLLEGQNASVLAYGPTGAGKTHTMLGSPEQPGVIPRALMDLLQLTREEGAEGRPWALSVTMSYLEIYQEKVLDLLDPASGDLVIREDCRGNILIPGLSQKPISSFADFERHFLPASRNRTVGATRLNQRSSRSHAVLLVKVDQRERLAPFRQREGKLYLIDLAGSEDNRRTGNKGLRLKESGAINTSLFVLGKVVDALNQGLPRVPYRDS

SEQ ID NO: 2681 - protein, 255 aa, Homo sapiens
MFPVFPCTLLAPPFPVLGLDSRGVGGLMNSFPPPQGHAQNPLQVGAELQSRFFASQGCAQSPFQAAPAPPPTPQAPAAEPLQVDLLPVLAAAQESAAAAAAAAAAAAAVAAAPPAPAAASTVDTAALKQPPAPPPPPPPVSAPAAEAAPPASAATIAAAAATAVVAPTSTVAVAPVASALEKKTKSKGPYICALCAKEFKNGYNLRRHEAIHTGAKAGRVPSGAMKMPTMVPLSLLSVPQLSGAGGGGGEAGAGG

SEQ ID NO: 2682 - protein, 461 aa, Homo sapiens
MSRQVVRSSKFRHVFGQPAKADQCYEDVRVSQTTWDSGFCAVNPKFVALICEASGGGAFLVLPLGKTGRVDKNAPTVCGHTAPVLDIAWCPHNDNVIASGSEDCTVMVWEIPDGGLMLPLREPVVTLEGHTKRVGIVAWHTTAQNVLLSAGCDNVIMVWDVGTGAAMLTLGPEVHPDTIYSVDWSRDGGLICTSCRDKRVRIIEPRKGTVVAEKDRPHEGTRPVRAVFVSEGKILTTGFSRMSERQVALWDTKHLEEPLSLQELDTSSGVLLPFFDPDTNIVYLCGKGDSSIRYFEITSEAPFLHYLSMFSSKESQRGMGYMPKRGLEVNKCEIARFYKLHERRCEPIAMTVPRKSDLFQEDLYPPTAGPDPALTAEEWLGGRDAGPLLISLKDGYVPPKSRELRVNRGLDTGRRRAAPEASGTPSSDAVSRLEEEMRKLQATVQELQKRLDRLEETVQAK

SEQ ID NO: 2683 - protein, 255 aa, Homo sapiens
MKDSCITVMAMALLSGFFFFAPASSYNLDVRGARSFSPPRAGRHFGYRVLQVGNGVIVGAPGEGNSTGSLYQCQSGTGHCLPVTLRGSNYTSKYLGMTLATDPTDGSILACDPGLSRTCDQNTYLSGLCYLFRQNLQGPMLQGRPGFQECIKGNVDLVFLFDGSMSLQPDEFQKILDFMKDVMKKLSNTSYQFAAVQFSTSYKTEFDFSDYVKRKDPDALLKHVKHMLLLTNTFGAINYVATEVFREELGARPDA

SEQ ID NO: 2684 - protein, 3230 aa, Homo sapiens
MQSSPSPAHPQLPVLQTQMVSDGMTGSNPVSPASSSSPASSGAGGISPQHIAQDSSLDGPPGPPDGATVPLEGFSLSQAADLANKGPKWEKSHAEIAEQAKHEAEIETRIAELRKEGFWSLKRLPKVPEPPRPKGHWDYLCEEMQWLSADFAQERRWKRGVARKVVRMVIRHHEEQRQKEERARREEQAKLRRIASTMAKDVRQFWSNVEKVVQFKQQSRLEEKRKKALDLHLDFIVGQTEKYSDLLSQSLNQPLTSSKAGSSPCLGSSSAASSPPPPASRLDDEDGDFQPQEDEEEDDEETIEVEEQQEGNDAEAQRREIELLRREGELPLEELLRSLPPQLLEGPSSPSQTPSSHDSDTRDGPEEGAEEEPPQVLEIKPPPSAVTQRNKQPWHPDEDDEEFTANEEEAEDEEDTIAAEEQLEGEVDHAMELSELAREGELSMEELLQQYAGAYAPGSGSSEDEDEDEVDANSSDCEPEGPVEAEEPPQEDSSSQSDSVEDRSEDEEDEHSEEEETSGSSASEESESEESEDAQSQSQADEEEEDDDFGVEYLLARDEEQSEADAGSGPPTPGPTTLGPKKEITDIAAAAESLQPKGYTLATTQVKTPIPLLLRGQLREYQHIGLDWLVTMYEKKLNGILADEMGLGKTIQTISLLAHLACEKGNWGPHLIIVPTSVMLNWEMELKRWCPSFKILTYYGAQKERKLKRQGWTKPNAFHVCITSYKLVLQDHQAFRRKNWRYLILDEAQNIKNFKSQRWQSLLNFNSQRRLLLTGTPLQNSLMELWSLMHFLMPHVFQSHREFKEWFSNPLTGMIEGSQEYNEGLVKRLHKVLRPFLLRRVKVDVEKQMPKKYEHVIRCRLSKRQRCLYDDFMAQTTTKETLATGHFMSVINILMQLRKVCNHPNLFDPRPVTSPFITPGICFSTASLVLRATDVHPLQRIDMGRFDLIGLEGRVSRYEADTFLPRHRLSRRVLLEVATAPDPPPRPKPVKMKVNRMLQPVPKQEGRTVVVVNNPRAPLGPVPVRPPPGPELSAQPTPGPVPQVLPASLMVSASPAGPPLIPASRPPGPVLLPPLQPNSGSLPQVLPSPLGVLSGTSRPPTPTLSLKPTPPAPVRLSPAPPPGSSSLLKPLTVPPGYTFPPAAATTTSTTTATATTTAVPAPTPAPQRLILSPDMQARLPSGEVVSIGQLASLAQRPVANAGGSKPLTFQIQGNKLTLTGAQVRQLAVGQPRPLQRNVVHLVSAGGQHHLISQPAHVALIQAVAPTPGPTPVSVLPSSTPSTTPAPTGLSLPLAANQVPPTMVNNTGVVKIVVRQAPRDGLTPVPPLAPAPRPPSSGLPAVLNPRPTLTPGRLPTPTLGTARAPMPTPTLVRPLLKLVHSPSPEVSASAPGAAPLTISSPLHVPSSLPGPASSPMPIPNSSPLASPVSSTVSVPLSSSLPISVPTTLPAPASAPLTIPISAPLTVSASGPALLTSVTPPLAPVVPAAPGPPSLAPSGASPSASALTLGLATAPSLSSSQTPGHPLLLAPTSSHVPGLNSTVAPACSPVLVPASALASPFPSAPNPAPAQASLLAPASSASQALATPLAPMAAPQTAILAPSPAPPLAPLPVLAPSPGAAPVLASSQTPVPVMAPSSTPGTSLASASPVPAPTPVLAPSSTQTMLPAPVPSPLPSPASTQTLALAPALAPTLGGSSPSQTLSLGTGNPQGPFPTQTLSLTPASSLVPTPAQTLSLAPGPPLGPTQTLSLAPAPPLAPASPVGPAPAHTLTLAPASSSASLLAPASVQTLTLSPAPVPTLGPAAAQTLALAPASTQSPASQASSLVVSASGAAPLPVTMVSRLPVSKDEPDTLTLRSGPPSPPSTATSFGGPRPRRQPPPPPRSPFYLDSLEEKRKRQRSERLERIFQLSEAHGALAPVYGTEVLDFCTLPQPVASPIGPRSPGPSHPTFWTYTEAAHRAVLFPQQRLDQLSEIIERFIFVMPPVEAPPPSLHACHPPPWLAPRQAAFQEQLASELWPRARPLHRIVCNMRTQFPDLRLIQYDCGKLQTLAVLLRQLKAEGHRVLIFTQMTRMLDVLEQFLTYHGHLYLRLDGSTRVEQRQALMERFNADKRIFCFILSTRSGGVGVNLTGADTVVFYDSDWNPTMDAQAQDRCHRIGQTRDVHIYRLISERTVEENILKKANQKRMLGDMAIEGGNFTTAYFKQQTIRELFDMPLEEPSSSSVPSAPEEEEETVASKQTHILEQALCRAEDEEDIRAATQAKAEQVAELAEFNENDGFPAGEGEEAGRPGAEDEEMSRAEQEIAALVEQLTPIERYAMKFLEASLEEVSREELKQAEEQVEAARKDLDQAKEEVFRLPQEEEEGPGAGDESSCGTGGGTHRRSKKAKAPERPGTRVSERLRGARAETQGANHTPVISAHQTRSTTTPPRCSPARERVPRPAPRPRPTPASAPAAIPALVPVPVSAPVPISAPNPITILPVHILPSPPPPSQIPPCSSPACTPPPACTPPPAHTPPPAQTCLVTPSSPLLLGPPSVPISASVTNLPLGLRPEAELCAQALASPESLELASVASSETSSLSLVPPKDLLPVAVEILPVSEKNLSLTPSAPSLTLEAGSIPNGQEQEAPDSAEGTTLTVLPEGEELPLCVSESNGLELPPSAASDEPLQEPLEADRTSEELTEAKTPTSSPEKPQELVTAEVAAPSTSSSATSSPEGPSPARPPRRRTSADVEIRGQGTGRPGQPPGPKVLRKLPGRLVTVVEEKELVRRRRQQRGAASTLVPGVSETSASPGSPSVRSMSGPESSPPIGGPCEAAPSSSLPTPPQQPFIARRHIELGVTGGGSPENGDGALLAITPPAVKRRRGRPPKKNRSPADAGRGVDEAPSSTLKGKTNGADPVPGPETLIVADPVLEPQLIPGPQPLGPQPVHRPNPLLSPVEKRRRGRPPKARDLPIPGTISSAGDGNSESRTQPPPHPSPLTPLPPLLVCPTATVANTVTTVTISTSPPKRKRGRPPKNPPSPRPSQLPVLDRDSTSVLESCGLGRRRQPQGQGESEGSSSDEDGSRPLTRLARLRLEAEGMRGRKSGGSMVVAVIQDDLDLADSGPGGLELTPPVVSLTPKLRSTRLRPGSLVPPLETEKLPRKRAGAPVGGSPGLAKRGRLQPPSPLGPEGSVEESEAEASGEEEEGDGTPRRRPGPRRLVGTTNQGDQRILRSSAPPSLAGPAVSHRGRKAKT

SEQ ID NO: 2685 - protein, 255 aa, Homo sapiens
MEDTPPSLSCSDCQRHFPSLPELSRHRELLHPSPNQDSEEADSIPRPYRCQQCGRGYRHPGSLVNHRRTHETGLFPCTTCGKDFSNPMALKSHMRTHAPEGRRRHRPPRPKEATPHLQGETVSTDSWGQRLGSSEGWENQTKHTEETPDCESVPDPRAASGTWEDLPTRQREGLASHPGPEDGADGWGPSTNSARAPPLPIPASSLLSNLEQYLAESVVNFTGGQEPTQSPPAEEERRYKCSQCGKTYKHAGSLT

SEQ ID NO: 2686 - protein, 147 aa, Homo sapiens
MFLNGNCLETLKKKEPEGGRRRLSHPGNMGWMRPSQETTPPDRSHHSGFGLFCGDPGPEIEPFSLWVFPQEMVLEIHQLFMDHEYPCHHITSHCTWVAAHWTTSQSCAAWQGCRRACCSTWWKSPAQCTRPTVMSATFETAQEPGPS

SEQ ID NO: 2687 - protein, 142 aa, Homo sapiens
MNSLEQAEAPRVVSLIPAVVSGNCQDLKAFERRLTEYIHCLQPATGRWRMLLIVVSVCTATGAWNWLIDPETQKVSFFTSLWNHPFFTISCITLIGLFFAGIHKRVVAPSIIAARCRTVLAEYNMSCDDTGKLILKPRPHVQ

SEQ ID NO: 2688 - protein, 255 aa, Homo sapiens
MSRCAQAAEVAATVPGAGVGNVGLRPPMVPRQASFFPPPVPNPFVQQTQIGSARRVQIVLLGIILLPIRVLLVALILLLAWPFAAISTVCCPEKLTHPITGWRRKITQTALKFLGRAMFFSMGFIVAVKGKIASPLEAPVFVAAPHSTFFDGIACVVAGLPSMVSRNENAQVPLIGRLLRAVQPVLVSRVDPDSRKNTINEIIKRTTSGGEWPQILVFPEGTCTNRSCLITFKPGAFIPGVPVQPVLLRYPNKLD

SEQ ID NO: 2689 - protein, 255 aa, Homo sapiens
MLAATVLTLALLGNAHACSKGTSHEAGIVCRITKPALLVLNHETAKVIQTAFQRASYPDITGEKAMMLLGQVKYGLHNIQISHLSIASSQVELVEAKSIDVSIQNVSVVFKGTLKYGYTTAWWLGIDQSIDFEIDSAIDLQINTQLTCDSGRVRTDAPDCYLSFHKLLLHLQGEREPGWIKQLFTNFISFTLKLVLKGQICKEINVISNIMADFVQTRAASILSDGDIGVDISLTGDPVITASYLESHHKGHFIY

SEQ ID NO: 2690 - protein, 152 aa, Homo sapiens
MDNVQPKIKHRPFCFSVKGHVKMLRLALTVTSMTFFIIAQAPEPYIVITGFEVTVILFFILLYVLRLDRLMKWLFWPLLDIINSLVTTVFMLIVSVLALIPETTTLTVGGGVFALVTAVCCLADGALIYRKLLFNPSGPYQKKPVHEKKEVL

SEQ ID NO: 2691 - protein, 231 aa, Homo sapiens
MDPEHAKPESSEAPSGNLKQPETAAALASSGSVVSSVPKAQRNISAKTAPRKHPAVSIRSAQSAAAARPQGSEGTAPSRKATTRPPPKPTLPPPTPSAHTESKLLNEMAIKERVEGRAKVPYKFRDSLKRFSFSPTGMLKILRLSLILGALACFIITQANESFITITSLEICIVVFFILIYVLTLHHLLTYLHWPLLDLTNSIITAVFLSVVAILAMQEKKRRHLLYVGGR

SEQ ID NO: 2692 - protein, 173 aa, Homo sapiens
MAPKGKVGTRGKKQIFEENRETLKFYLRIILGANAIYCLVTLVFFYSSASFWAWLALGFSLAVYGASYHSMSSMARAAFSEDGALMDGGMDLNMEQGMAEHLKDVILLTAIVQVLSCFSLYVWSFWLLAPGRALYLLWVNVLGPWFTADSGTPAPEHNEKRQRRQERRQMKRL

SEQ ID NO: 2693 - protein, 255 aa, Homo sapiens
MEGDAVEAIVEESETFIKGKERKTYQRRREGGQEEDACHLPQNQTDGGEVVQDVNSSVQMVMMEQLDPTLLQMKTEVMEGTVAPEAEAAVDDTQIITLQVVNMEEQPINIGELQLVQVPVPVTVPVATTSVEELQGAYENEVSKEGLAESEPMICHTLPLPEGFQVVKVGANGEVETLEQGELPPQEDPSWQKDPDYQPPAKKTKKTKKSKLRYTEEGKDVDVSVYDFEEEQQEGLLSEVNAEKVVGNMKPPKPT

SEQ ID NO: 2694 - protein, 255 aa, Homo sapiens
MPGFTCCVPGCYNNSHRDKALHFYTFPKDAELRRLWLKNVSRAGVSGCFSTFQPTTGHRLCSVHFQGGRKTYTVRVPTIFPLRGVNERKVARRPAGAAAARRRQQQQQQQQQQQQQQQQQQQQQQQQQQQQQSSPSASTAQTAQLQPNLVSASAAVLLTLQATVDSSQAPGSVQPAPITPTGEDVKPIDLTVQVEFAAAEGAAAAAAASELQAATAGLEAAECPMGPQLVVVGEEGFPDTGSDHSYSLSSGTTEE

SEQ ID NO: 2695 - protein, 127 aa, Homo sapiens
MGDKPIWEQIGSSFIQHYYQLFDNDRTQLGAIYIDASCLTWEGQQFQGKAAIVEKLSSLPFQKIQHSITAQDHQPTPDSCIISMVVGQLKADEDPIMGFHQMFLLKNINDAWVCTNDMFRLALHNFG

SEQ ID NO: 2696 - protein, 255 aa, Homo sapiens
MASCASIDIEDATQHLRDILKLDRPAGGPSAESPRPSSAYNGDLNGLLVPDPLCSGDSTSANKTGLRTMPPINLQEKQVICLSGDDSSTCIGILAKEVEIVASSDSSISSKARGSNKVKIQPVAKYDWEQKYYYGNLIAVSNSFLAYAIRAANNGSAMVRVISVSTSERTLLKGFTGSVADLAFAHLNSPQLACLDEAGNLFVWRLALVNGKIQEEILVHIRQPEGTPLNHFRRIIWCPFIPEESEDCCEESSPT

SEQ ID NO: 2697 - protein, 255 aa, Homo sapiens
MEAREPGRPTPTYHLVPNTSQSQVEEDVSSPPQRSSETMQLKKEISLLNGVSLVVGNMIGSGIFVSPKGVLVHTASYGMSLIVWAIGGLFSVVGALCYAELGTTITKSGASYAYILEAFGGFIAFIRLWVSLLVVEPTGQAIIAITFANYIIQPSFPSCDPPYLACRLLAAACICLLTFVNCAYVKWGTRVQDTFTYAKVVALIAIIVMGLVKLCQGHSEHFQDAFEGSSWDMGNLSLALYSALFSYSGWDTLNF

SEQ ID NO: 2698 - protein, 255 aa, Homo sapiens
MVLYTTPFPNSCLSALHCVSWALIFPCYWLVDRLAASFIPTTYEKRQRADDPCCLQLLCTALFTPIYLALLVASLPFAFLGFLFWSPLQSARRPYIYSRLEDKGLAGGAALLSEWKGTGPGKSFCFATANVCLLPDSLARVNNLFNTQARAKEIGQRIRNGAARPQIKIYIDSPTNTSISAASFSSLVSPQGGDGVARAVPGSIKRTASVEYKGDGGRHPGDEAANGPASGDPVDSSSPEDACIVRIGGEEGGRP

SEQ ID NO: 2699 - protein, 255 aa, Homo sapiens
MRVAAATAAAGAGPAMAVWTRATKAGLVELLLRERWVRVVAELSGESLSLTGDAAAAELEPALGPAAAAFNGLPNGGGAGDSLPGSPSRGLGPPSPPAPPRGPAGEAGASPPVRRVRVVKQEAGGLGISIKGGRENRMPILISKIFPGLAADQSRALRLGDAILSVNGTDLRQATHDQAVQALKRAGKEVLLEVKFIREVTPYIKKPSLVSDLPWEGAAPQSPSFSGSEDSGSPKHQNSTKDRKIIPLKMCFAAR

SEQ ID NO: 2700 - protein, 255 aa, Homo sapiens
MTTSTLQKAIDLVTKATEEDKAKNYEEALRLYQHAVEYFLHAIKYEAHSDKAKESIRAKCVQYLDRAEKLKDYLRSKEKHGKKPVKENQSEGKGSDSDSEGDNPEKKKLQEQLMGAVVMEKPNIRWNDVAGLEGAKEALKEAVILPIKFPHLFTGKRTPWRGILLFGPPGTGKSYLAKAVATEANNSTFFSVSSSDLMSKWLGESEKLVKNLFELARQHKPSIIFIDEVDSLCGSRNENESEAARRIKTEFLVQM

SEQ ID NO: 2701 - protein, 255 aa, Homo sapiens
MATDSWALAVDEQEAAVKSMTNLQIKEEKVKADTNGIIKTSTTAEKTDEEEKEDRAAQSLLNKLIRSNLVDNTNQVEVLQRDPNSPLYSVKSFEELRLKPQLLQGVYAMGFNRPSKIQENALPMMLAEPPQNLIAQSQSGTGKTAAFVLAMLSRVEPSDRYPQCLCLSPTYELALQTGKVIEQMGKFYPELKLAYAVRGNKLERGQKISEQIVIGTPGTVLDWCSKLKFIDPKKIKVFVLDEADVMIATQGHQDQ

SEQ ID NO: 2702 - protein, 255 aa, Homo sapiens
MLLPKKMKLLLFLVSQMAILALFFHMYSHNISSLSMKAQPERMHVLVLSSWRSGSSFVGQLFGQHPDVFYLMEPAWHVWMTFKQSTAWMLHMAVRDLIRAVFLCDMSVFDAYMEPGPRRQSSLFQWENSRALCSAPACDIIPQDEIIPRAHCRLLCSQQPFEVVEKACRSYSHVVLKEVRFFNLQSLYPLLKDPSLNLHIVHLVRDPRAVFRSRERTKGDLMIDSRIVMGQHEQKLKKEDQPYYVMQVICQSQLE

SEQ ID NO: 2703 - protein, 255 aa, Homo sapiens
MSALGAVIALLLWGQLFAVDSGNDVTDIADDGCPKPPEIAHGYVEHSVRYQCKNYYKLRTEGDGVYTLNDKKQWINKAVGDKLPECEADDGCPKPPEIAHGYVEHSVRYQCKNYYKLRTEGDGVYTLNNEKQWINKAVGDKLPECEAVCGKPKNPANPVQRILGGHLDAKGSFPWQAKMVSHHNLTTGATLINEQWLLTTAKNLFLNHSENATAKDIAPTLTLYVGKKQLVEIEKVVLHPNYSQVDIGLIKLKQK

SEQ ID NO: 2704 - protein, 255 aa, Homo sapiens
MSTTVNVDSLAEYEKSQIKRALELGTVMTVFSFRKSTPERRTVQVIMETRQVAWSKTADKIEGFLDIMEIKEIRPGKNSKDFERAKAVRQKEDCCFTILYGTQFVLSTLSLAADSKEDAVNWLSGLKILHQEAMNASTPTIIESWLRKQIYSVDQTRRNSISLRELKTILPLINFKVSSAKFLKDKFVEIGAHKDELSFEQFHLFYKKLMFEQQKSILDEFKKDSSVFILGNTDRPDASAVYLHDFQRFLIHEQQ

SEQ ID NO: 2705 - protein, 255 aa, Homo sapiens
MMEGSRQTRVSRPYKISESSKVYRWADHSSTVLQRLNEQRLRGLFCDVVLVADEQRVPAHRNLLAVCSDYFNSMFTIGMREAFQKEVELIGASYIGLKAVVDFLYGGELVLDGGNIDYVLETAHLLQIWTVVDFCCEYLEQEVSEDNYLYLQELASIYSLKRLDAFIDGFILNHFGTLSFTPDFLQNVSMQKLCVYLSSSEVQRECEHDLLQAALQWLTQQPEREAHARQVLENIHFPLIPKNDLLHRVKPAVCS

SEQ ID NO: 2706 - protein, 255 aa, Homo sapiens
MKGMSHEPKSPSLGMLSTATRTTATVNPLTPSPLNGALVPSGSPATSSALSAQAAPSSSFAAALRKLAKQAEEPRGSSLSSESSPVSSPATNHSSPASTPKRVPMGPIIVPPGGHSVPSTPPVVTIAPTKTVNGVWRSESRQDAGSRSSSGGRERLIVEPPLPQEKAGGPAIPSHLLSTPYPFGLSPSSVVQDSRFPPLNLQRPVHHVVPPSTVTEDYLRSFRPYHTTDDLRMSSLPPLGLDPATAAAYYHPSYL

SEQ ID NO: 2707 - protein, 255 aa, Homo sapiens
MMSEHDLADVVQIAVEDLSPDHPVVLENHVVTDEDEPALKRQRLEINCQDPSIKTICLRLDSIEAKLQALEATCKSLEEKLDLVTNKQHSPIQVPMVAGSPLGATQTCNKVRCVVPQTTVILNNDRQNAIVAKMEDPLSNRAPDSLENVISNAVPGRRQNTIVVKVPGQEDSHHEDGESGSEASDSVSSCGQAGSQSIGSNVTLITLNSEEDYPNGTWLGDENNPEMRVRCAIIPSDMLHISTNCRTAEKMALTL

SEQ ID NO: 2708 - protein, 140 aa, Homo sapiens
MAVCIAVIAKENYPLYIRSTPTENELKFHYMVHTSLDVVDEKISAMGKALVDQRELYLGLLYPTEDYKVYGYVTNSKVKFVMVVDSSNTALRDNEIRSMFRKLHNSYTDVMCNPFYNPGDRIQSSRAFDNMVTSMMIQVC

SEQ ID NO: 2709 - protein, 255 aa, Homo sapiens
MAVLLLLLRALRRGPGPGPRPLWGPGPAWSPGFPARPGRGRPYMASRPPGDLAEAGGRALQSLQLRLLTPTFEGINGLLLKQHLVQNPVRLWQLLGGTFYFNTSRLKQKNKEKDKSKGKAPEEDEEERRRRERDDQMYRERLRTLLVIAVVMSLLNALSTSGGSISWNDFVHEMLAKGEVQRVQVVPESDVVEVYLHPGAVVFGRPRLALMYRMQVANIDKFEEKLRAAEDELNIEAKDRIPVSYKRTGFFGNAL

SEQ ID NO: 2710 - protein, 283 aa, Homo sapiens
MDKEKDGIPISSLREITLLLRLRHPNIVELKEVVVGNHLESIFLVMGYCEQDLASLLENMPTPFSEAQVKCIVLQVLRGLQYLHRNFIIHRDLKVSNLLMTDKGCVKTADFGLARAYGVPVKPMTPKVVTLWYRAPELLLGTTTQTTSIDMWAVGCILAELLAHRPLLPGTSEIHQIDLIVQLLGTPSENIWPGFSKLPLVGQYSLRKQPYNNLKHKFPWLSEAGLRLLHFLFMATAGDCLESSYFKEKPLPCEPELMPTFPHHRNKRAAPATSEGQSKRCKP

SEQ ID NO: 2711 - protein, 255 aa, Homo sapiens
MSRRALRRLRGEQRGQEPLGPGALHFDLRDDDDAEEEGPKRELGVRRPGGAGKEGVRVNNRFELINIDDLEDDPVVNGERSGCALTDAVAPGNKGRGQRGNTESKTDGDDTETVPSEQSHASGKLRKKKKKQKNKKSSTGEASENGLEDIDRILERIEDSTGLNRPGPAPLSSRKHVLYVEHRHLNPDTELKRYFGARAILGEQRPRQRQRVYPKCTWLTTPKSTWPRYSKPGLSMRLLESKKGLSFFAFEHSEE

SEQ ID NO: 2712 - protein, 69 aa, Homo sapiens
VVVLAGTNRPDVLDPALMRPGRFHRQIYTGPPYIKGRSSIFKVHLRPLKLDKSLNKDTLARKLAVLTPG

SEQ ID NO: 2713 - protein, 255 aa, Homo sapiens
MSAQAQMRALLDQLMGTARDGDETRQRVKFTDDRVCKSHLLDCCPHDILAGTRMDLGECTKIHDLALRADYEIASKERDLFFELDAMDHLESFIAECDRRTELAKKRLAETQEEISAEVSAKAEKVHELNEEIGKLLAKAEQLGAEGNVDESQKILMEVEKVRAKKKEAEEEYRNSMPASSFQQQKLRVCEVCSAYLGLHDNDRRLADHFGGKLHLGFIQIREKLDQLRKTVAEKQEKRNQDRLRRREEREREER

SEQ ID NO: 2714 - protein, 255 aa, Homo sapiens
MNIQEQGFPLDLGASFTEDAPRPPVPGEEGELVSTDPRPASYSFCSGKGVGIKGETSTATPRRSDLDLGYEPEGSASPTPPYLKWAESLHSLLDDQDGISLFRTFLKQEGCADLLDFWFACTGFRKLEPCDSNEEKRLKLARAIYRKYILDNNGIVSRQTKPATKSFIKGCIMKQLIDPAMFDQAQTEIQATMEENTYPSFLKSDIYLEYTRTGSESPKVCSDQSSGSGTGKGISGYLPTLNEDEEWKCDQDMDE

SEQ ID NO: 2715 - protein, 255 aa, Homo sapiens
MAGGWAQGSRRAARLPEGGRLMAPASRLLALWALAAVALPGSGAEGDGGWRPGGPGAVAEEERCTVERRADLTYAEFVQQYAFVRPVILQGLTDNSRFRALCSRDRLLASFGDRVVRLSTANTYSYHKVDLPFQEYVEQLLHPQDPTSLGNDTLYFFGDNNFTEWASLFRHYSPPPFGLLGTAPAYSFGIAGAGSGVPFHWHGPGYSEVIYGRKRWFLYPPEKTPEFHPNKTTLAWLRDTYPALPPSARPLECTI

SEQ ID NO: 2716 - protein, 307 aa, Homo sapiens
MASVLSYESLVHAVAGAVGSVTAMTVFFPLDTARLRLQVDEKRKSKTTHMVLLEIIKEEGLLAPYRGWFPVISSLCCSNFVYFYTFNSLKALWVKGQHSTTGKDLVVGFVAGVVNVLLTTPLWVVNTRLKLQGAKFRNEDIVPTNYKGIIDAFHQIIRDEGISALWNGTFPSLLLVFNPAIQFMFYEGLKRQLLKKRMKLSSLDVFIIGAVAKAIATTVTYPLQTVQSILRFGRHRLNPENRTLGSLRNILYLLHQRVRRFGIMGLYKGLEAKLLQTVLTAALMFLVYEKLTAATFTVMGLKRAHQH

SEQ ID NO: 2717 - protein, 680 aa, Homo sapiens
MPSVSKAAAAALSGSPPQTEKPTHYRYLKEFRTEQCPLFSQHKCAQHRPFTCFHWHFLNQRRRRPLRRRDGTFNYSPDVYCSKYNEATGVCPDGDECPYLHRTTGDTERKYHLRYYKTGTCIHETDARGHCVKNGLHCAFAHGPLDLRPPVCDVRELQAQEALQNGQLGGGEGVPDLQPGVLASQAMIEKILSEDPRWQDANFVLGSYKTEQCPKPPRLCRQGYACPHYHNSRDRRRNPRRFQYRSTPCPSVKHGDEWGEPSRCDGGDGCQYCHSRTEQQFHPESTKCNDMRQTGYCPRGPFCAFAHVEKSLGMVNEWGCHDLHLTSPSSTGSGQPGNAKRRDSPAEGGPRGSEQDSKQNHLAVFAAVHPPAPSVSSSVASSLASSAGSGSSSPTALPAPPARALPLGPASSTVEAVLGSALDLHLSNVNIASLEKDLEEQDGHDLGAAGPRSLAGSAPVAIPGSLPRAPSLHSPSSASTSPLGSLSQPLPGPVGSSAMTPPQQPPPLRSEPGTLGSAASSYSPLGLNGVPGSIWDFVSGSFSPSPSPILSAGPPSSSSASPNGAELARVRRQLDEAKRKIRQWEESWQQVKQVCDAWQREAQEAKERARVADSDRQLALQKKEEVEAQVIFQLRAKQCVACRERAHGAVLRPCQHHILCEPCAATAPECPYCKGQPLQW

SEQ ID NO: 2718 - protein, 255 aa, Homo sapiens
MPSVSKAAAAALSGSPPQTEKPTHYRYLKEFRTEQCPLFSQHKCAQHRPFTCFHWHFLNQRRRRPLRRRDGTFNYSPDVYCSKYNEATGVCPDGDECPYLHRTTGDTERKYHLRYYKTGTCIHETDARGHCVKNGLHCAFAHGPLDLRPPVCDVRELQAQEALQNGQLGGGEGVPDLQPGVLASQAMIEKILSEDPRWQDANFVLGSYKTEQCPKPPRLCRQGYACPHYHNSRDRRRNPRRFQYSWQLGRRVLRL

SEQ ID NO: 2719 - protein, 255 aa, Homo sapiens
MANVSKKVSWSGRDRDDEEAAPLLRRTARPGGGTPLLNGAGPGAARQDMDPPHPFPKEIPHNEKLLSLKYESLDYDNSENQLFLEEERRINHTAFRTVEIKRWVICALIGILTGLVACFIDIVVENLAGLKYRVIKGNIDKFTEKGGLSFSLLLWATLNAAFVLVGSVIVAFIEPVAAGSGIPQIKCFLNGVKIPHVVRLKTLVIKVSGVILSVVGGLAVGKEGPMIHSGSVIAAGISQGRSTSLKRDFKIFEYF

SEQ ID NO: 2720 - protein, 218 aa, Homo sapiens
MARKKVRPRLIAELARRVRALREQLNRPRDSQLYAVDYETLTRPFSGRRLPVRAWADVRRESRLLQLLGRLPLFGLGRLVTRKSWLWQHDEPCYWRLTRVRPDYTAQNLDHGKAWGILTFKGKTESEAREIEHVMYHDWRLVPKHEEEAFTAFTPAPEDSLASVPYPPLLRAMIIAERQKNGDTSTEEPMLNVQRIRMEPWDYPAKQEDKGRAKGTPV

SEQ ID NO: 2721 - protein, 255 aa, Homo sapiens
MDLSGVKKKSLLGVKENNKKSSTRAPSPTKRKDRSDEKSKDRSKDKGATKESSEKDRGRDKTRKRRSASSGSSSTRSRSSSTSSSGSSTSTGSSSGSSSSSASSRSGSSSTSRSSSSSSSSGSPSPSRRRHDNRRRSRSKSKPPKRDEKERKRRSPSPKPTKVHIGRLTRNVTKDHIMEIFSTYGKIKMIDMPVERMHPHLSKGYAYVEFENPDEAEKALKHMDGGQIDGQEITATAVLAPWPRPPPRRFSPPRR

SEQ ID NO: 2722 - protein, 255 aa, Homo sapiens
MRKQEVRTGREAGQGHGTGSPAEQVKALMDLLAGKGSQGSQAPQALDRTPDAPLGPCSNDSRIQRHRKALLSKVGGGPELGGPWHRLASLLLVEGLTDLQLREHDFTQVEATRGGGHPARTVALDRLFLPLSRVSVPPRVSITIGVAGMGKTTLVRHFVRLWAHGQVGKDFSLVLPLTFRDLNTHEKLCADRLICSVFPHVGEPSLAVAVPARALLILDGLDECRTPLDFSNTVACTDPKKEIPVDHLITNIIRG

SEQ ID NO: 2723 - protein, 255 aa, Homo sapiens
MARELRALLLWGRRLRPLLRAPALAAVPGGKPILCPRRTTAQLGPRRNPAWSLQAGRLFSTQTAEDKEEPLHSIISSTESVQGSTSKHEFQAETKKLLDIVARSLYSEKEVFIRELISNASDALEKLRHKLVSDGQALPEMEIHLQTNAEKGTITIQDTGIGMTQEELVSNLGTIARSGSKAFLDALQNQAEASSKIIGQFGVGFYSAFMVADRVEVYSRSAAPGSLGYQWLSDGSGVFEIAEASGVRTGTKIII

SEQ ID NO: 2724 - protein, 255 aa, Homo sapiens
MASPPHQQLLHHHSTEVSCDSSGDSNSVRVKINPKQLSSNSHPKHCKYSISSSCSSSGDSGGVPRRVGGGGRLRRQKKLPQLFERASSRWWDPKFDSVNLEEACLERCFPQTQRRFRYALFYIGFACLLWSIYFAVHMRSRLIVMVAPALCFLLVCVGFFLFTFTKLYARHYAWTSLALTLLVFALTLAAQFQVLTPVSGRGDSSNLTATARPTDTCLSQVGSFSMCIEVLFLLYTVMHLPLYLSLCLGVAYSVL

SEQ ID NO: 2725 - protein, 255 aa, Homo sapiens
MNRFRVSKFRHTEARPPRRESWISDIRAGTAPSCRNHIKSSCSLIAFNSDRPGVLGIVPLQGQGEDKRRVAHLGCHSDLVTDLDFSPFDDFLLATGSADRTVKLWRLPGPGQALPSAPGVVLGPEDLPVEVLQFHPTSDGILVSAAGTTVKVWDAAKQQPLTELAAHGDLVQSAVWSRDGALVGTACKDKQLRIFDPRTKPRASQSTQAHENSRDSRLAWMGTWEHLVSTGFNQMREREVKLWDTRFFSSALASL

SEQ ID NO: 2726 - protein, 275 aa, Homo sapiens
MEERKEEGEAEIQEHGPEHWFSKWERQCLAEAEQDEQLPPELQEEAAAAAQPEHKQQKLWHLFQNSATAVAQLYKDRVCQQPGLSLWVPFQNAATAVTNLYKESVDTHQRSFDIGIQIGYQRRNKDVLAWVKKRRRTIRREDLISFLCGKVPPPRNSRAPPRLTVVSPNRATSTETSSSVETDLQPFREAIALHGLSGAMASISVRSSTPGSPTHVSSGSNASRRRNGLHDVDLNTFISEEMALHLDNGGTRKRTSAQCGDVITDSPTHKRNRMI

SEQ ID NO: 2727 - protein, 651 aa, Homo sapiens
MAAPLLHTRLPGDAAASSSAVKKLGASRTGISNMRALENDFFNSPPRKTVRFGGTVTEVLLKYKKGETNDFELLKNQLLDPDIKDDQIINWLLEFRSSIMYLTKDFEQLISIILRLPWLNRSQTVVEEYLAFLGNLVSAQTVFLRPCLSMIASHFVPPRVIIKEGDVDVSDSDDEDDNLPANFDTCHRALQIIARYVPSTPWFLMPILVEKFPFVRKSERTLECYVHNLLRISVYFPTLRHEILELIIEKLLKLDVNASRQGIEDAEETATQTCGGTDSTEGLFNMDEDEETEHETKAGPERLDQMVHPVAERLDILMSLVLSYMKDVCYVDGKVDNGKTKDLYRDLINIFDKLLLPTHASCHVQFFMFYLCSFKLGFAEAFLEHLWKKLQDPSNPAIIRQAAGNYIGSFLARAKFIPLITVKSCLDLLVNWLHIYLNNQDSGTKAFCDVALHGPFYSACQAVFYTFVFRHKQLLSGNLKEGLQYLQSLNFERIVMSQLNPLKICLPSVVNFFAAITNKYQLVFCYTIIERNNRQMLPVIRSTAGGDSVQICTNPLDTFFPFDPCVLKRSKKFIDPIYQVWEDMSAEELQEFKKPMKKDIVEDEDDDFLKGEVPQNDTVIGITPSSFDTHFRSPSSSVGSPPVLYMQPSPL

SEQ ID NO: 2728 - protein, 255 aa, Homo sapiens
MVAAPCARRLARRSHSALLAALTVLLLQTLVVWNFSSLDSGAGERRGGAAVGGGEQPPPAPAPRRERRDLPAEPAAARGGGGGGGGGGGGRGPQARARGGGPGEPRGQQPASRGALPARALDPHPSPLITLETQDGYFSHRPKEKVRTDSNNENSVPKDFENVDNSNFAPRTQKQKHQPELAKKPPSRQKELLKRKLEQQEKGKGHTFPGKGPGEVLPPGDRAAANSSHGKDVSRPPHARKTGGSSPETKYDQPP

SEQ ID NO: 2729 - protein, 122 aa, Homo sapiens; identical to SEQ ID NO: 2670

SEQ ID NO: 2730 - protein, 241 aa, Homo sapiens
MGTASRSNIARHLQTNLILFCVGAVGACTLSVTQPWYLEVDYTHEAVTIKCTFSATGCPSEQPTCLWFRYGAHQPENLCLDGCKSEADKFTVREALKENQVSLTVNRVTSNDSAIYICGIAFPSVPEARAKQTGGGTTLVVREIKLLSKELRSFLTALVSLLSVYVTGVCVAFILLSKSKSNPLRNKEIKEDSQKKKSARRIFQEIAQELYHKRHVETNQQSEKDNNTYENRRVLSNYERP

SEQ ID NO: 2731 - protein, 454 aa, Homo sapiens
MLAENLVEEFEMKEDEPWYDHQDLQQDLQLAAELGKTLLDRNTELEDSVQQMYTTNQEQLQEIEYLTKQVELLRQMNEQHAKVYEQLDVTARELEETNQKLVADSKASQQKILSLTETIECLQTNIDHLQSQVEELKSSGQGRRSPGKCDQEKPAPSFACLKELYDLRQHFVYDHVFAEKITSLQGQPSPDEEENEHLKKTVTMLQAQLSLERQKRVTMEEEYGLVLKENSELEQQLGATGAYRARALELEAEVAEMRQMLQSEHPFVNGVEKLVPDSLYVPFKEPSQSLLEEMFLTVPESHRKPLKRSSSETILSSLAGSDIVKGHEETCIRRAKAVKQRGISLLHEVDTQYSALKVKYEELLKKCQEEQDSLSHKAVQTSRAAAKDLTGVNAQSEPVASGWELASVNPEPVSSPTTPPEYKALFKEIFSCIKKTKQEIDEQRTKYRSLSSHS

SEQ ID NO: 2732 - protein, 255 aa, Homo sapiens
MDFSKFLADDFDVKEWINAAFRAGSKEAASGKADGHAATLVMKLQLFIQEVNHAVEETSHQALQNMPKVLRDVEALKQEASFLKEQMILVKEDIKKFEQDTSQSMQVLVEIDQVKSRMQLAAESLQEADKWSTLSADIEETFKTQDIAVISAKLTGMQNSLMMLVDTPDYSEKCVHLEALKNRLEALASPQIVAAFTSQAVDQSKVFVKVFTEIDRMPQLLAYYYKCHKVQLLAAWQELCQSDLSLDRQLTGLYD

SEQ ID NO: 2733 - protein, 255 aa, Homo sapiens
MAATAVAAAVAGTESAQGPPGPAASLELWLNKATDPSMSEQDWSAIQNFCEQVNTDPNGPTHAPWLLAHKIQSPQEKEALYALTVLEMCMNHCGEKFHSEVAKFRFLNELIKVLSPKYLGSWATGKVKGRVIEILFSWTVWFPEDIKIRDAYQMLKKQGIIKQDPKLPVDKILPPPSPWPKSSIFDADEEKSKLLTRLLKSNHPEDLQAANRLIKNLVKEEQEKSEKVSKRVSAVEEVRSHVKVLQEMLSMYRRP

SEQ ID NO: 2734 - protein, 255 aa, Homo sapiens
MQGSTRRMGVMTDVHRRFLQLLMTHGVLEEWDVKRLQTHCYKVHDRNATVDKLEDFINNINSVLESLYIEIKRGVTEDDGRPIYALVNLATTSISKMATDFAENELDLFRKALELIIDSETGFASSTNILNLVDQLKGKKMRKKEAEQVLQKFVQNKWLIEKEGEFTLHGRAILEMEQYIRETYPDAVKICNICHSLLIQGQSCETCGIRMHLPCVAKYFQSNAEPRCPHCNDYWPHEIPKVFDPEKERESGVLK

SEQ ID NO: 2735 - protein, 255 aa, Homo sapiens
MDALESLLDEVALEGLDGLCLPALWSRLETRVPPFPLPLEPCTQEFLWRALATHPGISFYEEPRERPDLQLQDRYEEIDLETGILESRRDPVALEDVYPIHMILENKDGIQGSCRYFKERKNITNDIRTKSLQPRCTMVEAFDRWGKKLIIVASQAMRYRALIGQEGDPDLKLPDFSYCILERLGRSRWQGELQRDLHTTAFKVDAGKLHYHRKILNKNGLITMQSHVIRLPTGAQQHSILLLLNRFHVDRRSKY

SEQ ID NO: 2736 - protein, 255 aa, Homo sapiens
MALVSADSRIAELLTELHQLIKQTQEERSRSEHNLVNIQKTHERMQTENKISPYYRTKLRGLYTTAKADAEAECNILRKALDKIAEIKSLLEERRIAAKIAGLYNDSEPPRKTMRRGVLMTLLQQSAMTLPLWIGKPGDKPPPLCGAIPASGDYVARPGDKVAARVKAVDGDEQWILAEVVSYSHATNKYEVDDIDEEGKERHTLSRRRVIPLPQWKANPETDPEALFQKEQLVLALYPQTTCFYRALIHAPPQR

SEQ ID NO: 2737 - protein, 224 aa, Homo sapiens
MPLTPEPPSGRVEGPPAWEAAPWPSLPCGPCIPIMLVLATLAALFILTTAVLAERLFRRALRPDPSHRAPTLVWRPGGELWIEPMGTARERSEDWYGSAVPLLTDRAPEPPTQVGTLEARATAPPAPSAPNSAPSNLGPQTVLEVPARSTFWGPQPWEGRPPATGLVSWAEPEQRPEASVQFGSPQARRQRPGSPDPEWGLQPRVTLEQISAFWKREGRTSVGF

SEQ ID NO: 2738 - protein, 255 aa, Homo sapiens
MSAEASGPAAAAAPSLEAPKPSGLEPGPAAYGLKPLTPNSKYVKLNVGGSLHYTTLRTLTGQDTMLKAMFSGRVEVLTDAGGWVLIDRSGRHFGTILNYLRDGSVPLPESTRELGELLGEARYYLVQGLIEDCQLALQQKRETLSPLCLIPMVTSPREEQQLLASTSKPVVKLLHNRSNNKYSYTSTSDDNLLKNIELFDKLALRFHGRLLFLKDVLGDEICCWSFYGQGRKIAEVCCTSIVYATEKKQTKVEFP

SEQ ID NO: 2739 - protein, 255 aa, Homo sapiens
MSHHDDGATVGLGIQMCEGWRVEAALSFLPHQRKWGETAGAVMAGGVMDKEYVGFAALPNQLHRKSVKKGFDFTLMVAGESGLGKSTLINSLFLTNLYEDRQVPEASARLTQTLAIERRGVEIEEGGVKVKLTLVDTPGFGDSVDCSDCWLPVVKFIEEQFEQYLRDESGLNRKNIQDSRVHCCLYFISPFGRGLRPLDVAFLRAVHEKVNIIPVIGKADALMPQETQALKQKIRDQLKEEEIHIYQFPECDSDE

SEQ ID NO: 2740 - protein, 191 aa, Homo sapiens
MTDPSLGLTVPMAPPLAPLPPRDPNGAGSEWRKPGAVSFADVAVYFSREEWGCLRPAQRALYRDVMRETYGHLGALGESPTCLPGPCASTGPAAPLGAACGVGGPGAGQAASSQRGVCVLLPQESEAASRRSSPGWRRRPNCGIRLPRIRRWRSVRQKRTQQIPETRKRKDKGKGREPWRSPTLWPPGLLG

SEQ ID NO: 2741 - protein, 255 aa, Homo sapiens
MEEHTEAGSAPEMGAQKALIDNPADILVIAAYFLLVIGVGLWSMCRTNRGTVGGYFLAGRSMVWWPVGASLFASNIGSGHFVGLAGTGAASGLAVAGFEWNALFVVLLLGWLFAPVYLTAGVITMPQYLRKRFGGRRIRLYLSVLSLFLYIFTKISVDMFSGAVFIQQALGWNIYASVIALLGITMIYTVTGGLAALMYTDTVQTFVILGGACILMGYAFHEVGGYSGLFDKYLGAATSLTVSEDPAVGNISSFC

SEQ ID NO: 2742 - protein, 255 aa, Homo sapiens
MAAAGRLPSSWALFSPLLAGLALLGVGPVPARALHNVTAELFGAEAWGTLAAFGDLNSDKQTDLFVLRERNDLIVFLADQNAPYFKPKVKVSFKNHSALITSVVPGDYDGDSQMDVLLTYLPKNYAKSELGAVIFWGQNQTLDPNNMTILNRTFQDEPLIMDFNGDLIPDIFGITNESNQPQILLGGNLSWHPALTTTSKMRIPHSHAFIDLTEDFTADLFLTTLNATTSTFQFEIWENLDGNFSVSTILEKPQN

SEQ ID NO: 2743 - protein, 255 aa, Homo sapiens
MTRKRTYWVPNSSGGLVNRGIDIGDDMVSGLIYKTYTLQDGPWSQQERNPEAPGRAAVPPWGKYDAALRTMIPFRPKPRFPAPQPLDNAGLFSYLTVSWLTPLMIQSLRSRLDENTIPPLSVHDASDKNVQRLHRLWEEEVSRRGIEKASVLLVMLRFQRTRLIFDALLGICFCIASVLGPILIIPKILEYSEEQLGNVVHGVGLCFALFLSECVKSLSFSSSWIINQRTAIRFRAAVSSFAFEKLIQFKSVIHI

SEQ ID NO: 2744 - protein, 227 aa, Homo sapiens
MSVVPPNRSQTGWPRGVTQFGNKYIQQTKPLTLERTINLYPLTNYTFGTKEPLYEKDSSVAARFQRMREEFDKIGMRRTVEGVLIVHEHRLPHVLLLQLGTTFFKLPGGELNPGEDEVEGLKRLMTEILGRQDGVLQDWVIDDCIGNWWRPNFEPPQYPYIPAHITKPKEHKKLFLVQLQEKALFAVPKNYKLVAAPLFELYDNAPGYGPIISSLPQLLSRFNFIYN

SEQ ID NO: 2745 - protein, 255 aa, Homo sapiens
MNGKRPAEPGPARVGKKGKKEVMAEFSDAVTEETLKKQVAEAWSRRTPFSHEVIVMDMDPFLHCVIPNFIQSQDFLEGLQKELMNLDFHEKYNDLYKFQQSDDLKKRREPHISTLRKILFEDFRSWLSDISKIDLESTIDMSCAKYEFTDALLCHDDELEGRRIAFILYLVPPWDRSMGGTLDLYSIDEHFQPKQIVKSLIPSWNKLVFFEVSPVSFHQVSEVLSEEKSRLSISGWFHGPSLTRPPNYFEPPIPR

SEQ ID NO: 2746 - protein, 255 aa, Homo sapiens
MPGPAAGSRARVYAEVNSLRSREYWDYEAHVPSWGNQDDYQLVRKLGRGKYSEVFEAINITNNERVVVKILKPVKKKKIKREVKILENLRGGTNIIKLIDTVKDPVSKTPALVFEYINNTDFKQLYQILTDFDIRFYMYELLKALDYCHSKGIMHRDVKPHNVMIDHQQKKLRLIDWGLAEFYHPAQEYNVRVASRYFKGPELLVDYQMYDYSLDMWSLGCMLASMIFRREPFFHGQDNYDQLVRIAKVLGTEEL

SEQ ID NO: 2747 - protein, 255 aa, Homo sapiens
MALLHSGRVLPGIAAAFHPGLAAAASARASSWWTHVEMGPPDPILGVTEAFKRDTNSKKMNLGVGAYRDDNGKPYVLPSVRKAEAQIAAKNLDKEYLPIGGLAEFCKASAELALGENSEVLKSGRFVTVQTISGTGALRIGASFLQRFFKFSRDVFLPKPTWGNHTPIFRDAGMQLQGYRYYDPKTCGFDFTGAVEDISKIPEQSVLLLHACAHNPTGVDPRPEQWKEIATVVKKRNLFAFFDMAYQGFASGDGD

SEQ ID NO: 2748 - protein, 163 aa, Homo sapiens
MVGGGGVGGGLLENANPLIYQRSGERPVTAGEEDEQVPDSIDAREIFDLIRSINDPEHPLTLEELNVVEQVRVQVSDPESTVAVAFTPTIPHCSMATLIGLSIKVKLLRSLPQRFKMDVHITPGTHASEHAVNKQLADKERVAAALENTHLLEVVNQCLSARS

SEQ ID NO: 2749 - protein, 255 aa, Homo sapiens
MAGGEDRGDGEPVSVVTVRVQYLEDTDPFACANFPEPRRAPTCSLDGALPLGAQIPAVHRLLGAPLKLEDCALQVSPSGYYLDTELSLEEQREMLEGFYEEISKGRKPTLILRTQLSVRVNAILEKLYSSSGPELRRSLFSLKQIFQEDKDLVPEFVHSEGLSCLIRVGAAADHNYQSYILRALGQLMLFVDGMLGVVAHSDTIQWLYTLCASLSRLVVKTALKLLLVFVEYSENNAPLFIRAVNSVASTTGAPP

SEQ ID NO: 2750 - protein, 255 aa, Homo sapiens
MSFFPELYFNVDNGYLEGLVRGLKAGVLSQADYLNLVQCETLEDLKLHLQSTDYGNFLANEASPLTVSVIDDRLKEKMVVEFRHMRNHAYEPLASFLDFITYSYMIDNVILLITGTLHQRSIAELVPKCHPLGSFEQMEAVNIAQTPAELYNAILVDTPLAAFFQDCISEQDLDEMNIEIIRNTLYKAYLESFYKFCTLLGGTTADAMCPILEFEADRRAFIITINSFGTELSKEDRAKLFPHCGRLYPEGLAQL

SEQ ID NO: 2751 - protein, 112 aa, Homo sapiens
MKMLPGVGVFGTGSSARVLVPLLRAEGFTVEALWGKTEEEAKQLAEEMNIAFYTSRTDDILLHQDVDLVCISIPPPLTRQISVKALGTPGRPQQGQIMSLPLGSPLRVTPLL

SEQ ID NO: 2752 - protein, 255 aa, Homo sapiens
MPHFTVVPVDGPRRGDYDNLEGLSWVDYGERAELDDSDGHGNHRESSPFLSPLEASRGIDYYDRNLALFEEELDIRPKVSSLLGKLVSYTNLTQGAKEHEEAESGEGTRRRAAEAPSMGTLMGVYLPCLQNIFGVILFLRLTWMVGTAGVLQALLIVLICCCCTLLTAISMSAIATNGVVPAGGSYFMISRSLGPEFGGAVGLCFYLGTTFAAAMYILGAIEILLTYIAPPAAIFYPSGAHDTSNATLNNMRVYG

SEQ ID NO: 2753 - protein, 255 aa, Homo sapiens
MIRTPLSASAHRLLLPGSRGRPPRNMQPTGREGSRALSRRYLRRLLLLLLLLLLRQPVTRAETTPGAPRALSTLGSPSLFTTPGVPSALTTPGLTTPGTPKTLDLRGRAQALMRSFPLVDGHNDLPQVLRQRYKNVLQDVNLRNFSHGQTSLDRLRDGLVGAQFWSASVSCQSQDQTAVRLALEQIDLIHRMCASYSELELVTSAEGLNSSQKLACLIGVEGGHSLDSSLSVLRSFYVLGVRYLTLTFTCSTPWA

SEQ ID NO: 2754 - protein, 255 aa, Homo sapiens
MQPSGLEGPGTFGRWPLLSLLLLLLLLQPVTCAYTTPGPPRALTTLGAPRAHTMPGTYAPSTTLSSPSTQGLQEQARALMRDFPLVDGHNDLPLVLRQVYQKGLQDVNLRNFSYGQTSLDRLRDGLVGAQFWSAYVPCQTQDRDALRLTLEQIDLIRRMCASYSELELVTSAKALNDTQKLACLIGVEGGHSLDNSLSILRTFYMLGVRYLTLTHTCNTPWAESSAKGVHSFYNNISGLTDFGEKVVAEMNRLGM

SEQ ID NO: 2755 - protein, 219 aa, Homo sapiens
MNSYMLISAPAILGTSNMPAAVPATQPGTLQPPMVLLDFPPLACFLNNILVAFNDLRLCCPVALAQDVTGALEDALAKVTKIILAFHRAEEAAFSSGEQELFVQFCTVFLEDLVPYLNRCLQVLFPPAQIAQTLGIPPTQLSKYGNLGHVNIGAIQEPLAFILPKRETLFTLDDQALGPELTAPAPEPPAEEPRLEPAGPACPEGGRAETQAEPPSVGP

SEQ ID NO: 2756 - protein, 255 aa, Homo sapiens; identical to SEQ ID NO: 2700

SEQ ID NO: 2757 - protein, 255 aa, Homo sapiens
MAAGAGTAGPASGPGVVRDPAASQPRKRPGREGGEGARRSDTMAGGGGSSDGSGRAAGRRASRSSGRARRGRHEPGLGGPAERGAGEARLEEAVNRWVLKFYFHEALRAFRGSRYGDFRQIRDIMQALLVRPLGKEHTVSRLLRVMQCLSRIEEGENLDCSFDMEAELTPLESAINVLEMIKTEFTLTEAVVESSRKLVKEAAVIICIKNKEFEKASKILKKHMSKDPTTQKLRNDLLNIIREKNLAHPVIQNFS

SEQ ID NO: 2758 - protein, 255 aa, Homo sapiens
MDSTLTASEIRQRFIDFFKRNEHTYVHSSATIPLDDPTLLFANAGMNQFKPIFLNTIDPSHPMAKLSRAANTQKCIRAGGKHNDLDDVGKDVYHHTFFEMLGSWSFGDYFKELACKMALELLTQEFGIPIERLYVTYFGGDEAAGLEADLECKQIWQNLGLDDTKILPGNMKDNFWEMGDTGPCGPCSEIHYDRIGGRDAAHLVNQDDPNVLEIWNLVFIQYNREADGILKPLPKKSIDTGMGLERLVSVLQNKM

SEQ ID NO: 2759 - protein, 255 aa, Homo sapiens
MKCSLRVWFLSVAFLLVFIMSLLFTYSHHSMATLPYLDSGALDGTHRVKLVPGYAGLQRLSKERLSGKSCACRRCMGDAGASDWFDSHFDGNISPVWTRENMDLPPDVQRWWMMLQPQFKSHNTNEVLEKLFQIVPGENPYRFRDPHQCRRCAVVGNSGNLRGSGYGQDVDGHNFIMRMNQAPTVGFEQDVGSRTTHHFMYPESAKNLPANVSFVLVPFKVLDLLWIASALSTGQIRFTYAPVKSFLRVDKEKVQ

SEQ ID NO: 2760 - protein, 255 aa, Homo sapiens
MNPEKDFAPLTPNIVRALNDKLYEKRKVAALEIEKLVREFVAQNNTVQIKHVIQTLSQEFALSQHPHSRKGGLIGLAACSIALGKDSGLYLKELIEPVLTCFNDADSRLRYYACEALYNIVKVARGAVLPHFNVLFDGLSKLAADPDPNVKSGSELLDRLLKDIVTESNKFDLVSFIPLLRERIYSNNQYARQFIISWILVLESVPDINLLDYLPEILDGLFQILGDNGKEIRKMCEVVLGEFLKEIKKNPSSVK

SEQ ID NO: 2761 - protein, 255 aa, Homo sapiens
MPAPIRLRELIRTIRTARTQAEEREMIQKECAAIRSSFREEDNTYRCRNVAKLLYMHMLGYPAHFGQLECLKLIASQKFTDKRIGYLGAMLLLDERQDVHLLMTNCIKNDLNHSTQFVQGLALCTLGCMGSSEMCRDLAGEVEKLLKTSNSYLRKKAALCAVHVIRKVPELMEMFLPATKNLLNEKNHGVLHTSVVLLTEMCERSPDMLAHFRKLVPQLVRILKNLIMSGYSPEHDVSGISDPFLQVRILRLLRI

SEQ ID NO: 2762 - protein, 255 aa, Homo sapiens
MAARWSSENVVVEFRDSQATAMSVDCLGQHAVLSGRRFLYIVNLDAPFEGHRKISRQSKWDIGAVQWNPHDSFAHYFAASSNQRVDLYKWKDGSGEVGTTLQGHTRVISDLDWAVFEPDLLVTSSVDTYIYIWDIKDTRKPTVALSAVAGASQVKWNKKNANCLATSHDGDVRIWDKRKPSTAVEYLAAHLSKIHGLDWHPDSEHILATSSQDNSVKFWDYRQPRKYLNILPCQVPVWKARYTPFSNGLVTVMVP

SEQ ID NO: 2763 - protein, 255 aa, Homo sapiens
MASLWLLSCFSLVGAAFGCGVPAIHPVLSGLSRIVNGEDAVPGSWPWQVSLQDKTGFHFCGGSLISEDWVVTAAHCGVRTSDVVVAGEFDQGSDEENIQVLKIAKVFKNPKFSILTVNNDITLLKLATPARFSQTVSAVCLPSADDDFPAGTLCATTGWGKTKYNANKTPDKLQQAALPLLSNAECKKSWGRRITDVMICAGASGVSSCMGDSGGPLVCQKDGAWTLVGIVSWGSDTCSTSSPGVYARVTKLIPW

SEQ ID NO: 2764 - protein, 255 aa, Homo sapiens
MQVEKGATGISLSPHLPGELAICSRSGAVCLWSPEDGLRQIYRDPETLVFRDSSSWRWADFTAHPRVLTVGDRTGVKMLDTQGPPGCGLLLFRLGAEASCQKGERVLLTQYLGHSSPKCLPPTLHLVCTQFSLYLVDERLPLVPMLKWNHGLPSPLLLARLLPPPRPSCVQPLLLGGQGGQLQLLHLAGEGASVPRLAGPPQSLPSRIDSLPAFPLLEPKIQWRLQERLKAPTIGLAAVVPPLPSAPTPGLVLFQ

SEQ ID NO: 2765 - protein, 255 aa, Homo sapiens
MAVCARLCGVGPSRGCRRRQQRRGPAETAAADSEPDTDPEEERIEASAGVGGGLCAGPSPPPPRCSLLELPPELLVEIFASLPGTDLPSLAQVCTKFRRILHTDTIWRRRCREEYGVCENLRKLEITGVSCRDVYAKLLHRYRHILGLWQPDIGPYGGLLNVVVDGLFIIGWMYLPPHDPHVDDPMRFKPLFRIHLMERKAATVECMYGHKGPHHGHIQIVKKDEFSTKCNQTDHHRMSGGRQEEFRTWLREEWG

SEQ ID NO: 2766 - protein, 255 aa, Homo sapiens
MASNHPAFSFHQKQVLRQELTQIQSSLNGGGGHGGKGAPGPGGALPTCPACHKITPRTEAPVSSVSNSLENALHTSAHSTEESLPKRPLGKHSKVSVEKIDLKGLSHTKNDRNVECSFEVLWSDSSITSVTKSSSEVTEFISKLCQLYPEENLEKLIPCLAGPDAFYVERNHVDLDSGLRYLASLPSHVLKNDHVRRFLSTSSPPQQLQSPSPGNPSLSKVGTVMGVSGRPVCGVAGIPSSQSGAQHHGQHPAGS

SEQ ID NO: 2767 - protein, 255 aa, Homo sapiens
MEPHVLGAVLYWLLLPCALLAACLLRFSGLSLVYLLFLLLLPWFPGPTRCGLQGHTGRLLRALLGLSLLFLVAHLALQICLHIVPRLDQLLGPSCSRWETLSRHIGVTRLDLKDIPNAIRLVAPDLGILVVSSVCLGICGRLARNTRQSPHPRELDDDERDVDASPTAGLQEAATLAPTRRSRLAARFRVTAHWLLVAAGRVLAVTLLALAGIAHPSALSSVYLLLFLALCTWWACHFPISTRGFSRLCVAVGCF

SEQ ID NO: 2768 - protein, 187 aa, Homo sapiens
MPGERPTDATVIPSAKRERKAITLDLKLEVLRRFEAGEKLSQIAKALDLAISTVATIRDSKEKIKASSQIATPLRASRLTRHRSAVMESMEQLLSLWLEDQSQPNATLSAAIVQEKAEFDDLQREHGEGSQTERFHASQGWLVRFKECHCLPHFKMNSAAPSNKDMYTEMLKSIIEEGEYTPQVSLT

SEQ ID NO: 2769 - protein, 194 aa, Homo sapiens
MAAAAPNAGGSAPETAGSAEAPLQYSLLLQYLVGDKRQPRLLEPGSLGGIPSPAKSEEQKMIEKAMESCAFKAALACVGGFVLGGAFGVFTAGIDTNVGFDPKDPYRTPTAKEVLKDMGQRGMSYAKNFAIVGAMFSCTECLIESYRGTSDWKNSVISGCITGGAIGFRAGLKAGAIGCGGFAAFSAAIDYYLR

SEQ ID NO: 2770 - protein, 255 aa, Homo sapiens
MVGQLSEGAIAAIMQKGDTNIKPILQVINIRPITTGNSPPRYRLLMSDGLNTLSSFMLATQLNPLVEEEQLSSNCVCQIHRFIVNTLKDGRRVVILMELEVLKSAEAVGVKIGNPVPYNEGLGQPQVAPPAPAASPAASSRPQPQNGSSGMGSTVSKAYGASKTFGKAAGPSLSHTSGGTQSKVVPIASLTPYQSKWTICARVTNKSQIRTWSNSRGEGKLFSLELVDESGEIRATAFNEQVDKFFPLIEVNKVY

SEQ ID NO: 2771 - protein, 227 aa, Homo sapiens
MAAQRPLRVLCLAGFRQSERGFREKTGALRKALRGRAELVCLSGPHPVPDPPGPEGARSDFGSCPPEEQPRGWWFSEQEADVFSALEEPAVCRGLEESLGMVAQALNRLGPFDGLLGFSQGAALAALVCALGQAGDPRFPLPRFILLVSGFCPRGIGFKESILQRPLSLPSLHVFGDTDKVIPSQESVQLASQFPGAITLTHSGGHFIPAAAPQRQAYLKFLDQFAE

SEQ ID NO: 2772 - protein, 255 aa, Homo sapiens
MGSAEDAVKEKLLWNVKKEVKQIMEEAVTRKFVHEDSSHIIALCGAVEACLLHQLRRRAAGFLRSDKMAALFTKVGKTCPVAGEICHKVQELQQQAEGRKPSGVSQEALRRQGSASGKAPALSPQALKHVWVRTALIEKVLDKVVQYLAENCSKYYEKEALLADPVFGPILASLLVGPCALEYTKLKTADHYWTDPSADELVQRHRIRGPPTRQDSPAKRPALGIRKRHSSGSASEDRLAACARECVESLHQNSR

SEQ ID NO: 2773 - protein, 255 aa, Homo sapiens
MGEKPGTRVFKKSSPNCKLTVYLGKRDFVDHLDKVDPVDGVVLVDPDYLKDRKVFVTLTCAFRYGREDLDVLGLSFRKDLFIATYQAFPPVPNPPRPPTRLQDRLLRKLGQHAHPFFFTIPQNLPCSVTLQPGPEDTGKACGVDFEIRAFCAKSLEEKSHKRNSVRLVIRKVQFAPEKPGPQPSAETTRHFLMSDRSLHLEASLDKELYYHGEPLNVNVHVTNNSTKTVKKIKVSVRQYADICLFSTAQYKCPVA

SEQ ID NO: 2774 - protein, 145 aa, Homo sapiens
MDTFTVQDSTAMSWWRNNFWIILAVAIIVVSVGLGLILYCVCKWQLRRGKKWEIAKPLKHKQVDEEKMYENVLNESPVQLPPLPPRNWPSLEDSSPQEAPSQPPATYSLVNKVKNKKTVSIPSYIEPEDDYDDVEIPANTEKASF

SEQ ID NO: 2775 - protein, 255 aa, Homo sapiens
MSSKAEKKQRLSGRGSSQASWSGRATRAAVATQEQGNAPAVSEPELQAELPKEEPEPRLEGPQAQSEESVEPEADVKPLFLSRAALTGLADAVWTQEHDAILEHFAQDPTESILTIFIDPCFGLKLELGMPVQTQNQLVYFIRQAPVPITWENFEATVQFGTVRGPYIPALLRLLGGVFAPQIFANTGWPESIRNHFASHLHKFLACLTDTRYKLEGHTVLYIPAEAMNMKPEMVIKDKELVQRLETSMIHWTRQ

SEQ ID NO: 2776 - protein, 252 aa, Homo sapiens
MEAMWLLCVALAVLAWGFLWVWDSSERMKSREQGGRLGAESRTLLVIAHPDDEAMFFAPTVLGLARLRHWVYLLCFSAGNYYNQGETRKKELLQSCDVLGIPLSSVMIIDNRDFPDDPGMQWDTEHVARVLLQHIEVNGINLVVTFDAGGVSGHSNHIALYAAVRALHSEGKLPKGCSVLTLQSVNVLRKYISLLDLPLSLLHTQDVLFVLNSKEVAQAKKAMSCHRSQLLWFRRLYIIFSRYMRINSLSFL

SEQ ID NO: 2777 - protein, 255 aa, Homo sapiens
MTSPSSSPVFRLETLDGGQEDGSEADRGKLDFGSGLPPMESQFQGEDRKFAPQIRVNLNYRKGTGASQPDPNRFDRDRLFNAVSRGVPEDLAGLPEYLSKTSKYLTDSEYTEGSTGKTCLMKAVLNLKDGVNACILPLLQIDRDSGNPQPLVNAQCTDDYYRGHSALHIAIEKRSLQCVKLLVENGANVHARACGRFFQKGQGTCFYFGELPLSLAACTKQWDVVSYLLENPHQPASLQATDSQGNTVLHALVMI

SEQ ID NO: 2778 - protein, 255 aa, Homo sapiens
MSAAKENPCRKFQANIFNKSKCQNCFKPRESHLLNDEDLTQAKPIYGGWLLLAPDGTDFDNPVHRSRKWQRRFFILYEHGLLRYALDEMPTTLPQGTINMNQCTDVVDGEGRTGQKFSLCILTPEKEHFIRAETKEIVSGWLEMLMVYPRTNKQNQKKKRKVEPPTPQEPGPAKVAVTSSSSSSSSSSSIPSAEKVPTTKSTLWQEEMRTKDQPDGSSLSPAQSPSQSQPPAASSLREPGLESKEEESAMSSDRM

SEQ ID NO: 2779 - protein, 255 aa, Homo sapiens
MGILEKISEIEKEIARTQKNKATEYHLGLLKAKLAKYRAQLLEPSKSASSKGEGFDVMKSGDARVALIGFPSVGKSTFLSLMTSTASEAASYEFTTLTCIPGVIEYKGANIQLLDLPGIIEGAAQGKGRGRQVIAVARTADVIIMMLDATKGEVQRSLLEKELESVGIRLNKHKPNIYFKPKKGGGISFNSTVTLTQCSEKLVQLILHEYKIFNAEVLFREDCSPDEFIDVIVGNRVYMPCLYVYNKIDQISMEE

SEQ ID NO: 2780 - protein, 255 aa, Homo sapiens
MAAASGYTDLREKLKSMTSRDNYKAGSREAAAAAAAAVAAAAAAAAAAEPYPVSGAKRKYQEDSDPERSDYEEQQLQKEEEARKVKSGIRQMRLFSQDECAKIEARIDEVVSRAEKGLYNEHTVDRAPLRNKYFFGEGYTYGAQLQKRGPGQERLYPPGDVDEIPEWVHQLVIQKLVEHRVIPEGFVNSAVINDYQPGGCIVSHVDPIHIFERPIVSVSFFSDSALCFGCKFQFKPIRVSEPVLSLPVRRGSVTV

SEQ ID NO: 2781 - protein, 255 aa, Homo sapiens
MAEFSQKRGKRRSDEGLGSMVDFLLANARLVLGVGGAAVLGIATLAVKRFIDRATSPRDEDDTKADSWKELSLLKATPHLQPRPPPAALSQPVLPLAPSSSAPEGPAETDPEVTPQLSSPAPLCLTLQERLLAFERDRVTIPAAQVALAKQLAGDIALELQAYFRSKFPELPFGAFVPGGPLYDGLQAGAADHVRLLVPLVLEPGLWSLVPGVDTVARDPRCWAVRRTQLEFCPRGSSPWDRFLVGGYLSSRVLL

SEQ ID NO: 2782 - protein, 255 aa, Homo sapiens
MASFPPRVNEKEIVRLRTIGELLAPAAPFDKKCGRENWTVAFAPDGSYFAWSQGHRTVKLVPWSQCLQNFLLHGTKNVTNSSSLRLPRQNSDGGQKNKPREHIIDCGDIVWSLAFGSSVPEKQSRCVNIEWHRFRFGQDQLLLATGLNNGRIKIWDVYTGKLLLNLVDHTEVVRDLTFAPDGSLILVSASRDKTLRVWDLKDDGNMMKVLRGHQNWVYSCAFSPDSSMLCSVGASKAVFLWNMDKYTMIRKLEGH

SEQ ID NO: 2783 - protein, 255 aa, Homo sapiens
MPSTNRAGSLKDPEIAELFFKEDPEKLFTDLREIGHGSFGAVYFARDVRTNEVVAIKKMSYSGKQSTEKWQDIIKEVKFLQRIKHPNSIEYKGCYLREHTAWLVMEYCLGSASDLLEVHKKPLQEVEIAAITHGALQGLAYLHSHTMIHRDIKAGNILLTEPGQVKLADFGSASMASPANSFVGTPYWMAPEVILAMDEGQYDGKVDVWSLGITCIELAERKPPLFNMNAMSALYHIAQNESPTLQSNEWSDYFR

SEQ ID NO: 2784 - protein, 255 aa, Homo sapiens
MRFVLSGNLHGGSVVASYPFDDSPEHKATGIYSKTSDDEVFKYLAKAYASNHPIMKTGEPHCPGDEDETFKDGITNGAHWYDVEGGMQDYNYVWANCFEITLELSCCKYPPASQLRQEWENNRESLITLIEKVHIGVKGFVKDSITGSGLENATISVAGINHNITTGRFGDFYRLLVPGTYNLTVVLTGYMPLTVTNVVVKEGPATEVDFSLRPTVTSVIPDTTEAVSTASTVAIPNILSGTSSSYQPIQPKDFH

SEQ ID NO: 2785 - protein, 739 aa, Homo sapiens
MAPQKHGGGGGGGSGPSAGSGGGGFGGSAAVAAATASGGKSGGGSCGGGGSYSASSSSSAAAAAGAAVLPVKKPKMEHVQADHELFLQAFEKPTQIYRFLRTRNLIAPIFLHRTLTYMSHRNSRTNIKRKTFKVDDMLSKVEKMKGEQESHSLSAHLQLTFTGFFHKNDKPSPNSENEQNSVTLEVLLVKVCHKKRKDVSCPIRQVPTGKKQVPLNPDLNQTKPGNFPSLAVSSNEFEPSNSHMVKSYSLLFRVTRPGRREFNGMINGETNENIDVNEELPARRKRNREDGEKTFVAQMTVFDKNRRLQLLDGEYEVAMQEMEECPISKKRATWETILDGKRLPPFETFSQGPTLQFTLRWTGETNDKSTAPIAKPLATRNSESLHQENKPGSVKPTQTIAVKESLTTDLQTRKEKDTPNENRQKLRIFYQFLYNNNTRQQTEARDDLHCPWCTLNCRKLYSLLKHLKLCHSRFIFNYVYHPKGARIDVSINECYDGSYAGNPQDIHRQPGFAFSRNGPVKRTPITHILVCRPKRTKASMSEFLESEDGEVEQQRTYSSGHNRLYFHSDTCLPLRPQEMEVDSEDEKDPEWLREKTITQIEEFSDVNEGEKEVMKLWNLHVMKHGFIADNQMNHACMLFVENYGQKIIKKNLCRNFMLHLVSMHDFNLISIMSIDKAVTKLREMQQKLEKGESASPANEEITEEQNGTANGFSEINSKEKALETDSVSGVSKQSKKQKL

SEQ ID NO: 2786 - protein, 255 aa, Homo sapiens
MAGLGLGSAVPVWLAEDDLGCIICQGLLDWPATLPCGHSFCRHCLEALWGARDARRWACPTCRQGAAQQPHLRKNTLLQDLADKYRRAAREIQAGSDPAHCPCPGSSSLSSAAARPRRRPELQRVAVEKSITEVAQELTELVEHLVDIVRSLQNQRPLSESGPDNELSILGKAFSSGVDLSMASPKLVTSDTAAGKIRDILHDLEEIQEKLQESVTWKEAPEAQMQGELLEAPSSSSCPLPDQSHPALRRASRFA

SEQ ID NO: 2787 - protein, 255 aa, Homo sapiens
MASSASARTPAGKRVINQEELRRLMKEKQRLSTSRKRIESPFAKYNRLGQLSCALCNTPVKSELLWQTHVLGKQHREKVAELKGAKEASQGSSASSAPHSVKRKAPDADDQDVKRAKATLVPQVQPSTSAWTTNFDKIGKEFIRATPSKPSGLSLLPDYEDEEEEEEEEEGDGERKRGDASKPLSDAQGKEHSVSSSREVTSSVLPNDFFSTNPPKAPIIPHSGSIEKAEIHEKVVERRENTAEALPEGFFDDPE

SEQ ID NO: 2788 - protein, 255 aa, Homo sapiens
MSDSGSYGQSGGEQQSYSTYGNPGSQGYGQASQSYSGYGQTTDSSYGQNYSGYSSYGQSQSGYSQSYGGYENQKQSSYSQQPYNNQGQQQNMESSGSQGGRAPSYDQPDYGQQDSYDQQSGYDQHQGSYDEQSNYDQQHDSYSQNQQSYHSQRENYSHHTQDDRRDVSRYGEDNRGYGGSQGGGRGRGGYDKDGRGPMTGSSGGDRGGFKNFGGHRDYGPRTDADSESDNSDNNTIFVQGLGEGVSTDQVGEFFK

SEQ ID NO: 2789 - protein, 255 aa, Homo sapiens
MARLVAVCRDGEEEFPFERRQIPLYIDDTLTMVMEFPDNVLNLDGHQNNGAQLKQFIQRHGMLKQQDLSIAMVVTSREVLSALSQLVPCVGCRRSVERLFSQLVESGNPALEPLTVGPKGVLSVTRSCMTDAKKLYTLFYVHGSKLNDMIDAIPKSKKNKRCQLHSLDTHKPKPLGGCWMDVWELMSQECRDEVVLIDSSCLLETLETYLRKHRFCTDCKNKVLRAYNILIGELDCSKEKGYCAALYEGLRCCPH

SEQ ID NO: 2790 - protein, 255 aa, Homo sapiens
MNPNCARCGKIVYPTEKVNCLDKFWHKACFHCETCKMTLNMKNYKGYEKKPYCNAHYPKQSFTMVADTPENLRLKQQSELQSQVRYKEEFEKNKGKGFSVVADTPELQRIKKTQDQISNIKYHEEFEKSRMGPSGGEGMEPERRDSQDGSSYRRPLEQQQPHHIPTSAPVYQQPQQQPVAQSYGGYKEPAAPVSIQRSAPGGGGKRYRAVYDYSAADEDEVSFQDGDTIVNVQQIDDGWMYGTVERTGDTGMLPA

SEQ ID NO: 2791 - protein, 255 aa, Homo sapiens
MKQEGSARRRGADKAKPPPGGGEQEPPPPPAPQDVEMKEEAATGGGSTGEADGKTAAAAAEHSQRELDTVTLEDIKEHVKQLEKAVSGKEPRFVLRALRMLPSTSRRLNHYVLYKAVQGFFTSNNATRDFLLPFLEEPMDTEADLQFRPRTGKAASTPLLPEVEAYLQLLVVIFMMNSKRYKEAQKISDDLMQKISTQNRRALDLVAAKCYYYHARVYEFLDKLDVVRSFLHARLRTATLRHDADGQATLLNLLL

SEQ ID NO: 2792 - protein, 255 aa, Homo sapiens
MPQTRSQAQATISFPKRKLSRALNKAKNSSDAKLEPTNVQTVTCSPRVKALPLSPRKRLGDDNLCNTPHLPPCSPPKQGKKENGPPHSHTLKGRRLVFDNQLTIKSPSKRELAKVHQNKILSSVRKSQEITTNSEQRCPLKKESACVRLFKQEGTCYQQAKLVLNTAVPDRLPAREREMDVIRNFLREHICGKKAGSLYLSGAPGTGKTACLSRILQDLKKELKGFKTIMLNCMSLRTAQAVFPAIAQEICQEEV

SEQ ID NO: 2793 - protein, 112 aa, Homo sapiens
MWKGGRSHPFLPCSSRRAGSGGQLDSILPHQSPAWGPWGCKDLSSGVPSFLTSSILWKSAVFAEDNGLKIHLCSYKRDDLVLFYDCTSFVLTFGPSPWFLTQGFLNPLEFSA

SEQ ID NO: 2794 - protein, 255 aa, Homo sapiens
MISRHLQNNLMSVDPASSQAMELSDVTLIEGVGNEVMVVAGVVVLILALVLAWLSTYVADSGSNQLLGAIVSAGDTSVLHLGHVDHLVAGQGNPEPTELPHPSEGNDEKAEEAGEGRGDSTGEAGAGGGVEPSLEHLLDIQGLPKRQAGAGSSSPEAPLRSEDSTCLPPSPGLITVRLKFLNDTEELAVARPEDTVGALKSKYFPGQESQMKLIYQGRLLQDPARTLRSLNITDNCVIHCHRSPPGSAVPGPSAS

SEQ ID NO: 2795 - protein, 157 aa, Homo sapiens
MHPWLGSALGFPKCRGIHLCACGNGWTPGETLSQNKTEITKNKVTCWRPHGCEPNTGLGYQGSHTSKYTLLPWNLLKTKPLPPSHGKEGGKEAKVPSGDNSGRGEVPRAQEGQAACGRAASGDSQEGMRRGYEERATAQRPAVRSAETTAHGTWIYP

SEQ ID NO: 2796 - protein, 255 aa, Homo sapiens
MAGRSMQAARCPTDELSLTNCAVVNEKDFQSGQHVIVRTSPNHRYTFTLKTHPSVVPGSIAFSLPQRKWAGLSIGQEIEVSLYTFDKAKQCIGTMTIEIDFLQKKSIDSNPYDTDKMAAEFIQQFNNQAFSVGQQLVFSFNEKLFGLLVKDIEAMDPSILKGEPATGKRQKIEVGLVVGNSQVAFEKAENSSLNLIGKAKTKENRQSIINPDWNFEKMGIGGLDKEFSDIFRRAFASRVFPPEIVEQMGCKHVKG

SEQ ID NO: 2797 - protein, 212 aa, Homo sapiens
MDPLFQQTHKQVHEIQSCMGRLETADKQSVHIVENEIQASIDQIFSRLERLEILSSKEPPNKRQNARLRVDQLKYDVQHLQTALRNFQHRRHAREQQERQREELLSRTFTTNDSDTTIPMDESLQFNSSLQKVHNGMDDLILDGHNILDGLRTQRLTLKGTQKKILDIANMLGLSNTVMRLIEKRAFQDKYFMIGGMLLTCVVMFLVVQYLT

SEQ ID NO: 2798 - protein, 255 aa, Homo sapiens
MWLAAAAPSLARRLLFLGPPPPPLLLLVFSRSSRRRLHSLGLAAMPEKRPFERLPADVSPINYSLCLKPDLLDFTFEGKLEAAAQVRQATNQIVMNCADIDIITASYAPEGDEEIHATGFNYQNEDEKVTLSFPSTLQTGTGTLKIDFVGELNDKMKGFYRSKYTTPSGEVRYAAVTQFEATDARRAFPCWDEPAIKATFDISLVVPKDRVALSNMNVIDRKPYPDDENLVEVKFARTPVMSTYLVAFVVGEYDF

SEQ ID NO: 2799 - protein, 255 aa, Homo sapiens
MELITILEKTVSPDRLELEAAQKFLERAAVENLPTFLVELSRVLANPGNSQVARVAAGLQIKNSLTSKDPDIKAQYQQRWLAIDANARREVKNYVLQTLGTETYRPSSASQCVAGIACAEIPVNQWPELIPQLVANVTNPNSTEHMKESTLEAIGYICQDIDPEQLQDKSNEILTAIIQGMRKEEPSNNVKLAATNALLNSLEFTKANFDKESERHFIMQVVCEATQCPDTRVRVAALQNLVKIMSLYYQYMETY

SEQ ID NO: 2800 - protein, 255 aa, Homo sapiens
MEDHQHVPIDIQTSKLLDWLVDRRHCSLKWQSLVLTIREKINAAIQDMPESEEIAQLLSGSYIHYFHCLRILDLLKGTEASTKNIFGRYSSQRMKDWQEIIALYEKDNTYLVELSSLLVRNVNYEIPSLKKQIAKCQQLQQEYSRKEEECQAGAAEMREQFYHSCKQYGITGENVRGELLALVKDLPSQLAEIGAAAQQSLGEAIDVYQASVGFVCESPTEQVLPMLRFVQKRGNSTVYEWRTGTEPSVVERPHL

SEQ ID NO: 2801 - protein, 136 aa, Homo sapiens
MQTAGALFISPALIRCCTRGLIRPVSASFLNSPVNSSKQPSYSNFPLQVARREFQTSVVSRDIDTAAKFIGAGAATVGVAGSGAGIGTVFGSLIIGYARNPSLKQQLFSYAILGFALSEAMGLFCLMVAFLILFAM

SEQ ID NO: 2802 - protein, 255 aa, Homo sapiens
MAESPTEEAATAGAGAAGPGASSVAGVVGVSGSGGGFGPPFLPDVWAAAAAAGGAGGPGSGLAPLPGLPPSAAAHGAALLSHWDPTLSSDWDGERTAPQCLLRIKRDIMSIYKEPPPGMFVVPDTVDMTKIHALITGPFDTPYEGGFFLFVFRCPPDYPIHPPRVKLMTTGNNTVRFNPNFYRNGKVCLSILGTWTGPAWSPAQSISSVLISIQSLMTENPYHNEPGFEQERHPGDSKNYNECIRHETIRVAVCD

SEQ ID NO: 2803 - protein, 255 aa, Homo sapiens
MVASARVQKLVRRYKLAIATALAILLLQGLVVWSFSGLEEDEAGEKGRQRKPRPLDPGEGSKDTDSSAGRRGSTGRRHGRWRGRAESPGVPVAKVVRAVTSRQRASRRVPPAPPPEAPGRQNLSGAAAGEALVGAAGFPPHGDTGSVEGAPQPTDNGFTPKCEIVGKDALSALARASTKQCQQEIANVVCLHQAGSLMPKAVPRHCQLTGKMSPGIQWDESQAQQPMDGPPVRIAYMLVVHGRAIRQLKRLLKAV

SEQ ID NO: 2804 - protein, 232 aa, Homo sapiens
MERCPSLGVTLYALVVVLGLRATPAGGQHYLHIRPAPSDNLPLVDLIEHPDPIFDPKEKDLNETLLRSLLGGHYDPGFMATSPPEDRPGGGGGAAGGAEDLAELDQLLRQRPSGAMPSEIKGLEFSEGLAQGKKQRLSKKLRRKLQMWLWSQTFCPVLYAWNDLGSRFWPRYVKVGSCFSKRSCSVPEGMVCKPSKSVHLTVLRWRCQRRGGQRCGWIPIQYPIISECKCSC

SEQ ID NO: 2805 - protein, 255 aa, Homo sapiens
MEAERRPAPGSPSEGLFADGHLILWTLCSVLLPVFITFWCSLQRSRRQLHRRDIFRKSKHGWRDTDLFSQPTYCCVCAQHILQGAFCDCCGLRVDEGCLRKADKRFQCKEIMLKNDTKVLDAMPHHWIRGNVPLCSYCMVCKQQCGCQPKLCDYRCIWCQKTVHDECMKNSLKNEKCDFGEFKNLIIPPSYLTSINQMRKDKKTDYEVLASKLGKQWTPLIILANSRSGTNMGEGLLGEFRILLNPVQVFDVTKT

SEQ ID NO: 2806 - protein, 255 aa, Homo sapiens
MAIQFRSLFPLALPGMLALLGWWWFFSRKKGHVSSHDEQQVEAGAVQLRADPAIKEPLPVEDVCPKVVSTPPSVTEPPEKELSTVSKLPAEPPALLQTHPPCRRSESSGILPNTTDMRLRPGTRRDDSTKLELALTGGEAKSIPLECPLSSPKGVLFSSKSAEVCKQDSPFSRVPRKVQPGYPVVPAEKRSSGERARETGGAEGTGDAVLGEKVLEEALLSREHVLELENSKGPSLASLEGEEDKGKSSSSQVVG

SEQ ID NO: 2807 - protein, 255 aa, Homo sapiens
MAENGKNCDQRRVAMNKEHHNGNFTDPSSVNEKKRREREERQNIVLWRQPLITLQYFSLEILVILKEWTSKLWHRQSIVVSFLLLLAVLIATYYVEGVHQQYVQRIEKQFLLYAYWIGLGILSSVGLGTGLHTFLLYLGPHIASVTLAAYECNSVNFPEPPYPDQIICPDEEGTEGTISLWSIISKVRIEACMWGIGTAIGELPPYFMARAARLSGAEPDDEEYQEFEEMLEHAESAQDFASRAKLAVQKLVQKV

SEQ ID NO: 2808 - protein, 255 aa, Homo sapiens
MAQILPIRFQEHLQLQNLGINPANIGFSTLTMESDKFICIREKVGEQAQVVIIDMNDPSNPIRRPISADSAIMNPASKVIALKAGKTLQIFNIEMKSKMKAHTMTDDVTFWKWISLNTVALVTDNAVYHWSMEGESQPVKMFDRHSSLAGCQIINYRTDAKQKWLLLTGISAQQNRVVGAMQLYSVDRKVSQPIEGHAASFAQFKMEGNAEESTLFCFAVRGQAGGKLHIIEVGTPPTGNQPFPKKAVDVFFPPE

SEQ ID NO: 2809 - protein, 255 aa, Homo sapiens
MRMLLALLALSAARPSASAESHWCYEVQAESSNYPCLVPVKWGGNCQKDRQSPINIVTTKAKVDKKLGRFFFSGYDKKQTWTVQNNGHSVMMLLENKASISGGGLPAPYQAKQLHLHWSDLPYKGSEHSLDGEHFAMEMHIVHEKEKGTSRNVKEAQDPEDEIAVLAFLVEAGTQVNEGFQPLVEALSNIPKPEMSTTMAESSLLDLLPKEEKLRHYFRYLGSLTTPTCDEKVVWTVFREPIQLHREQILAFSQK

SEQ ID NO: 2810 - protein, 236 aa, Homo sapiens
MEASDGQGGEGDKPLEQVTNVSCLETSSSASPARDSLMRHAKGLDQDTFKTCKEYLRPLKKFLRKLHLPRDLPQKKKLKYMKQSLVVLGDHINTFLQHYCQAWEIKHWRKMLWRFISLFSELEAKQLRRLYKYTKSSQPAKFLVTFCASDAPERSLLADREDSLPKLCHAWGLHSNISGMKERLSNMQTPGQGSPLPGQPRSQDHVKKDSLRELSQKPKLKRKRIKEAPETPETEP

SEQ ID NO: 2811 - protein, 255 aa, Homo sapiens
MSLHGKRKEIYKYEAPWTVYAMNWSVRPDKRFRLALGSFVEEYNNKVQLVGLDEESSEFICRNTFDHPYPTTKLMWIPDTKGVYPDLLATSGDYLRVWRVGETETRLECLLNNNKNSDFCAPLTSFDWNEVDPYLLGTSSIDTTCTIWGLETGQVLGRVNLVSGHVKTQLIAHDKEVYDIAFSRAGGGRDMFASVGADGSVRMFDLRHLEHSTIIYEDPQHHPLLRLCWNKQDPNYLATMAMDGMEVVILDVRVP

SEQ ID NO: 2812 - protein, 255 aa, Homo sapiens
MLLKEYRICMPLTVDEYKIGQLYMISKHSHEQSDRGEGVEVVQNEPFEDPHHGNGQFTEKRVYLNSKLPSWARAVVPKIFYVTEKAWNYYPYTITEYTCSFLPKFSIHIETKYEDNKGSNDTIFDNEAKDVEREVCFIDIACDEIPERYYKESEDPKHFKSEKTGRGQLREGWRDSHQPIMCSYKLVTVKFEVWGLQTRVEQFVHKVVRDILLIGHRQAFAWVDEWYDMTMDDVREYEKNMHEQTNIKVCNQHSS

SEQ ID NO: 2813 - protein, 408 aa, Homo sapiens
WYYGEHLFMLHGKSLTVIPYKCEVSSLAGALGKLKHSQDPGTHVVSHFVNWETPQGCGLGFQNSEQSRRILRRRKIEVSLQPEVPPSKQLLSTIMKDSEKHIEVEVRKFLALKQTPDFHTVIGDTVTGLLERCKAEPSFYPRNCLMQLIQTHVLSYSLCPDLMEIALKKKDVQLLQLCLQQFPDIPESVTCACLKIFLSIGDDSLQETDVNMESVFDYSINSVHDEKMEEQTEILQNGFNPEEDKCNNCDQELNKKPQDETKESTSCPVVQKRAALLNAILHSAYSETFLLPHLKDIPAQHITLFLKYLYFLYLKCSENATMTLPGIHPPTLNQIMDWICLLLDANFTVVVMMPEAKRLLINLYKLVKSQISVYSELNKIEVSFRELQKLNQEKNNRGLYSIEVLELF

SEQ ID NO: 2814 - protein, 255 aa, Homo sapiens
MSQSKGKKRNPGLKIPKEAFEQPQTSSTPPRDLDSKACISIGNQNFEVKADDLEPIMELGRGAYGVVEKMRHVPSGQIMAVKRIRATVNSQEQKRLLMDLDISMRTVDCPFTVTFYGALFREGDVWICMELMDTSLDKFYKQVIDKGQTIPEDILGKIAVSIVKALEHLHSKLSVIHRDVKPSNVLINALGQVKMCDFGISGYLVDSVAKTIDAGCKPYMAPERINPELNQKGYSVKSDIWSLGITMIELAILRF

SEQ ID NO: 2815 - protein, 255 aa, Homo sapiens
MATAATSPALKRLDLRDPAALFETHGAEEIRGLERQVRAEIEHKKEELRQMVGERYRDLIEAADTIGQMRRCAVGLVDAVKATDQYCARLRQAGSAAPRPPRAQQPQQPSQEKFYSMAAQIKLLLEIPEKIWSSMEASQCLHATQLYLLCCHLHSLLQLDSSSSRYSPVLSRFPILIRQVAAASHFRSTILHESKMLLKCQGVSDQAVAEALCSIMLLEESSPRQALTDFLLARKATIQKLLNQPHHGAGIKAQI

SEQ ID NO: 2816 - protein, 255 aa, Homo sapiens
MWLPWALLLLWVPGCFALSKCRTVAGPVGGSLSVQCPYEKEHRTLNKYWCRPPQIFLCDKIVETKGSAGKRNGRVSIRDSPANLSFTVTLENLTEEDAGTYWCGVDTPWLRDFHDPVVEVEVSVFPASTSMTPASITAAKTSTITTAFPPVSSTTLFAVGATHSASIQEETEEVVNSQLPLLLSLLALLLLLLVGASLLAWRMFQKWIKAGDHSELSQNPKQAATQSELHYANLELLMWPLQEKPAPPREVEVEY

SEQ ID NO: 2817 - protein, 255 aa, Homo sapiens
MAGEITETGELYSSYVGLVYMFNLIVGTGALTMPKAFATAGWLVSLVLLVFLGFMSFVTTTFVIEAMAAANAQLHWKRMENLKEEEDDDSSTASDSDVLIRDNYERAEKRPILSVQRRGSPNPFEITDRVEMGQMASMFFNKVGVNLFYFCIIVYLYGDLAIYAAAVPFSLMQVTCSATGNDSCGVEADTKYNDTDRCWGPLRRVDAYRIYLAIFTLLLGPFTFFDVQKTKYLQILTSLMRWIAFAVMIVLALIR

SEQ ID NO: 2818 - protein, 242 aa, Homo sapiens
MAAPAVKVARGWSGLALGVRRAVLQLPGLTQVRWSRYSPEFKDPLIDKEYYRKPVEELTEEEKYVRELKKTQLIKAAPAGKTSSVFEDPVISKFTNMMMIGGNKVLARSLMIQTLEAVKRKQFEKYHAASAEEQATIERNPYTIFHQALKNCEPMIGLVPILKGGRFYQVPVPLPDRRRRFLAMKWMITECRDKKHQRTLMPEKLSHKLLEAFHNQGPVIKRKHDLHKMAEANRALAHYRWW

SEQ ID NO: 2819 - protein, 255 aa, Homo sapiens
MDLKEKHLGEPPSALGLSTRKALSVLKEQLEAVLEGHLRERKKCLTWKEVWRSSFLHHSNRCSCFHWPGASLMLLAVLLLLGCCGGQPAGSRGVGLVNASALFLLLLLNLVLIGRQDRLKRREVERRLRGIIDQIQDALRDGREIQWPSAMYPDLHMPFAPSWSLHWAYRDGHLVNLPVSLLVEGDIIALRPGQESFASLRGIKDDEHIVLEPGDLFPPFSPPPSPRGEVERGPQSPQQHRLFRVLETPVIDNIR

SEQ ID NO: 2820 - protein, 255 aa, Homo sapiens
MEPEPEPAAVEVPAGRVLSARELFAARSRSQKLPQRSHGPKDFLPDGSAAQAERLRRCREELWQLLAEQRVERLGSLVAAEWRPEEGFVELKSPAGKFWQTMGFSEQGRQRLHPEEALYLLECGSIHLFHQDLPLSIQEAYQLLLTDHTVTFLQYQVFSHLKRLGYVVRRFQPSSVLSPYERQLNLDASVQHLEDGDGKRKRSSSSPRSINKKAKALDNSLQPKSLAASSPPPCSQPSQCPEEKPQESSPMKGPG

SEQ ID NO: 2821 - protein, 255 aa, Homo sapiens
MRRFLRPGHDPVRERLKRDLFQFNKTVEHGFPHQPSALGYSPSLRILAIGTRSGAIKLYGAPGVEFMGLHQENNAVTQIHLLPGQCQLVTLLDDNSLHLWSLKVKGGASELQEDESFTLRGPPGAAPSATQITVVLPHSSCELLYLGTESGNVFVVQLPAFRALEDRTISSDAVLQRLPEEARHRRVFEMVEALQEHPRDPNQILIGYSRGLVVIWDLQGSRVLYHFLSSQQLENIWWQRDGRLLVSCHSDGSYC

SEQ ID NO: 2822 - protein, 123 aa, Homo sapiens
MMLPKPGTYYLPWEVSAGQVPDGSTLRTFGRLCLYDMIQSRVTLMAQHGSDQHQVLVCTKLVEPFHAQVGSLYIVLGELQHQQDRGSVVKARVLTCVEGMNLPLLEQAIREQRLYKQERGGSQ

SEQ ID NO: 2823 - protein, 255 aa, Homo sapiens
MSPESKKLFNIIILGVAFMFMFTAFQTCGNVAQTVIRSLNRTDFHGSGYTSMAIIYGVFSASNLITPSVVAIVGPQLSMFASGLFYSMYIAVFIQPFPWSFYTASVFIGIAAAVLWTAQGNCLTINSDEHSIGRNSGIFWALLQSSLFFGNLYIYFAWQGKTQISESDRRTVFIALTVISLVGTVLFFLIRKPDSENVLGEDESSDDQDMEVNESAQNNLTKAVDAFKKSFKLCVTKEMLLLSITTAYTGLELTF

SEQ ID NO: 2824 - protein, 255 aa, Homo sapiens
MADTPRDAGLKQAPASRNEKAPVDFGYVGIDSILEQMRRKAMKQGFEFNIMVVGQSGLGKSTLINTLFKSKISRKSVQPTSEERIPKTIEIKSITHDIEEKGVRMKLTVIDTPGFGDHINNENCWQPIMKFINDQYEKYLQEEVNINRKKRIPDTRVHCCLYFIPATGHSLRPLDIEFMKRLSKVVNIVPVIAKADTLTLEERVHFKQRITADLLSNGIDVYPQKEFDEDSEDRLVNEKFREMIPFAVVGSDHEY

SEQ ID NO: 2825 - protein, 255 aa, Homo sapiens
MATGSAQGNFTGHTKKTNGNNGTNGALVQSPSNQSALGAGGANSNGSAARVWGVATGSSSGLAHCSVSGGDGKMDTMIGDGRSQNCWGASNSNAGINLNLNPNANPAAWPVLGHEGTVATGNPSSICSPVSAIGQNMGNQNGNPTGTLGAWGNLLPQESTEPQTSTSQNVSFSAQPQNLNTDGPNNTNPMNSSPNPINAMQTNGLPNWGMAVGMGAIIPPHLQGLPGANGSSVSQVSGGSAEGISNSVWGLSPGN

SEQ ID NO: 2826 - protein, 255 aa, Homo sapiens
MLLPRSVSSERAPGVPEPEELWEAEMERLRGSGTPVRGLPYAMMDKRLIWQLREPAGVQTLRWQRWQRRRQTVERRLREAAQRLARGLGLWEGALYEIGGLFGTGIRSYFTFLRFLLLLNLLSLLLTASFVLLPLVWLRPPDPGPTLNLTLQCPGSRQSPPGVLRFHNQLWHVLTGRAFTNTYLFYGAYRVGPESSSVYSIRLAYLLSPLACLLLCFCGTLRRMVKGLPQKTLLGQGYQAPLSAKVFSSWDFCIR

SEQ ID NO: 2827 - protein, 255 aa, Homo sapiens
MEAAAVTVTRSATRRRRRQLQGLAAPEAGTQEEQEDQEPRPRRRRPGRSIKDEEEETVFREVVSFSPDPLPVRYYDKDTTKPISFYLSSLEELLAWKPRLEDGFNVALEPLACRQPPLSSQRPRTLLCHDMMGGYLDDRFIQGSVVQTPYAFYHWQCIDVFVYFSHHTVTIPPVGWTNTAHRHGVCVLGTFITEWNEGGRLCEAFLAGDERSYQAVADRLVQITQFFRFDGWLINIENSLSLAAVGNMPPFLRYL

SEQ ID NO: 2828 - protein, 255 aa, Homo sapiens
MESEMLQSPLLGLGEEDEADLTDWNLPLAFMKKRHCEKIEGSKSLAQSWRMKDRMKTVSVALVLCLNVGVDPPDVVKTTPCARLECWIDPLSMGPQKALETIGANLQKQYENWQPRARYKQSLDPTVDEVKKLCTSLRRNAKEERVLFHYNGHGVPRPTVNGEVWVFNKNYTQYIPLSIYDLQTWMGSPSIFVYDCSNAGLIVKSFKQFALQREQELEVAAINPNHPLAQMPLPPSMKNCIQLAACEATELLPMI

SEQ ID NO: 2829 - protein, 255 aa, Homo sapiens
MRDSSAPSSASSSVTDLYCTPHSSRSDLVLPGTAGDFSLSASLSACTLLYEGAVEPMQIDVDPQEDPQNAPDVNYVVENPSLDLEQYAASYSGLMRIERLQFIADHCPTLRVEALKMALSFVQRTFNVDMYEEIHRKLSEATRELQNAPDAIPESGVEPPALDTAWVEATRKKALLKLEKLDTDLKNYKGNSIKESIRRGHDDLGDHYLDCGDLSNALKCYSRARDYCTSAKHVINMCLNVIKVSVYLQNWSHVL

SEQ ID NO: 2830 - protein, 197 aa, Homo sapiens [sequence omitted]

SEQ ID NO: 2831 - protein, 255 aa, Homo sapiens
MALSDEPAAGGPEEEAEDETLAFGAALEAFGESAETRALLGRLREVHGGGAEREVALERFRVIMDKYQEQPHLLDPHLEWMMNLLLDIVQDQTSPASLVHLAFKFLYIITKVRGYKTFLRLFPHEVADVEPVLDLVTIQNPKDHEAWETRYMLLLWLSVTCLIPFDFSRLDGNLLTQPGQARMSIMDRILQIAESYLIVSDKARDAAAVLVSRFITRPDVKQSKMAEFLDWSLCNLARSSFQTMQGVITMDGTLQ

SEQ ID NO: 2832 - protein, 255 aa, Homo sapiens
MDLGPLNICEEMTILHGGFLLAEQLFHPKALAELTKSDWERVGRPIVEALREISSAAAHSQPFAWKKKALIIIWAKVLQPHPVTPSDTETRWQEDLFFSVGNMIPTINHTILFELLKSLEASGLFIQLLMALPTTICHAELERFLEHVTVDTSAEDVAFFLDVWWEVMKHKGHPQDPLLSQFSAMAHKYLPALDEFPHPPKRLRSDPDACPTMPLLAMLLRGLTQIQSRILGPGRKCCALANLADMLTVFALTED

SEQ ID NO: 2833 - protein, 255 aa, Homo sapiens
MAARRALHFVFKVGNRFQTARFYRDVLGMKVLRHEEFEEGCKAACNGPYDGKWSKTMVGFGPEDDHFVAELTYNYGVGDYKLGNDFMGITLASSQAVSNARKLEWPLTEVAEGVFETEAPGGYKFYLQNRSLPQSDPVLKVTLAVSDLQKSLNYWCNLLGMKIYEKDEEKQRALLGYADNQCKLELQGVKGGVDHAAAFGRIAFSCPQKELPDLEDLMKRENQKILTPLVSLDTPGKATVQVVILADPDGHEICF

SEQ ID NO: 2834 - protein, 255 aa, Homo sapiens
MAPTLATAHRRRWWMACTAVLENLLFSAVLLGWGSLLIMLKSEGFYSYLCTEPENVTNGTVGGTAEPGHEEVSWMNGWLSCQAQDEMLNLAFTVGSFLLSAITLPLGIVMDKYGPRKLRLLGSACFAVSCLLIAYGASKPNALSVLIFIALALNGFGGMCMTFTSLTLPNMFGDLRSTFIALMIGSYASSAVTFPGIKLIYDAGVSFIVVLVVWAGCSGLVFLNCFFNWPLEPFPGPEDMDYSVKIKFSWLGFDH

SEQ ID NO: 2835 - protein, 255 aa, Homo sapiens
MAGVFPYRGPGNPVPGPLAPLPDYMSEEKLQEKARKWQQLQAKRYAEKRKFGFVDAQKEDMPPEHVRKIIRDHGDMTNRKFRHDKRVYLGALKYMPHAVLKLLENMPMPWEQIRDVPVLYHITGAISFVNEIPWVIEPVYISQWGSMWIMMRREKRDRRHFKRMRFPPFDDEEPPLDYADNILDVEPLEAIQLELDPEEDAPVLDWFYDHQPLRDSRKYVNGSTYQRWQFTLPMMSTLYRLANQLLTDLVDDNYF

SEQ ID NO: 2836 - protein, 255 aa, Homo sapiens
MAEGLERVRISASELRGILATLAPQAGSRENMKELKEARPRKDNRRPDLEIYKPGLSRLRNKPKIKEPPGSEEFKDEIVNDRDCSAVENGTQPVKDVCKELNNQEQNGPIDPENNRGQESFPRTAGQEDRSLKIIKRTKKPDLQIYQPGRRLQTVSKESASRVEEEEVLNQVEQLRVEEDECRGNVAKEEVANKPDRAEIEKSPGGGRVGAAKGEKGKRMGKGEGVRETHDDPARGRPGSAKRYSRSDKRRNRYR

SEQ ID NO: 2837 - protein, 255 aa, Homo sapiens
MALSKSMHARNRYKDKPPDFAYLASKYPDFKQHVQINLNGRVSLNFKDPEAVRALTCTLLREDFGLSIDIPLERLIPTVPLRLNYIHWVEDLIGHQDSDKSTLRRGIDIGTGASCIYPLLGATLNGWYFLATEVDDMCFNYAKKNVEQNNLSDLIKVVKVPQKTLLMDALKEESEIIYDFCMCNPPFFANQLEAKGVNSRNPRRPPPSSVNTGGITEIMAEGGELEFVKRIIHDSLQLKKRLRWYSCMLGKKCSL

SEQ ID NO: 2838 - protein, 255 aa, Homo sapiens
MAARPITLGIDLGTTSVKAALLRAAPDDPSGFAVLASCARAARAEAAVESAVAGPQGREQDVSRILQALHECLAALPRPQLRSVVGIGVSGQMHGVVFWKTGQGCEWTEGGITPVFEPRAVSHLVTWQDGRCSSEFLASLPQPKSHLSVATGFGCATIFWLLKYRPEFLKSYDAAGTIHDYVVAMLCGLPRPLMSDQNAASWGYFNTQSQSWNVETLRSSGFPVHLLPDIAEPGSVAGRTSHMWFEIPKGTQVGV

SEQ ID NO: 2839 - protein, 124 aa, Homo sapiens
MSYIPGQPVTAVVQRVEIHKLRQGENLILGFSIGGGIDQDPSQNPFSEDKTDKGIYVTRVSEGGPAEIAGLQIGDKIMQVNGWDMTMVTHDQARKRLTKRSEEVVRLLVTRQSLQKAVQQSMLS

SEQ ID NO: 2840 - protein, 422 aa, Homo sapiens
MGQAGCKGLCLSLFDYKTEKYVIAKNKKVGLLYRLLQASILAYLVVWVFLIKKGYQDVDTSLQSAVITKVKGVAFTNTSDLGQRIWDVADYVIPAQGENVFFVVTNLIVTPNQRQNVCAENEGIPDGACSKDSDCHAGEAVTAGNGVKTGRCLRRENLARGTCEIFAWCPLETSSRPEEPFLKEAEDFTIFIKNHIRFPKFNFSKSNVMDVKDRSFLKSCHFGPKNHYCPIFRLGSVIRWAGSDFQDIALEGGVIGINIEWNCDLDKAASECHPHYSFSRLDNKLSKSVSSGYNFRFARYYRDAAGVEFRTLMKAYGIRFDVMVNGKGAFFCDLVLIYLIKKREFYRDKKYEEVRGLEDSSQEAEDEASGLGLSEQLTSGPGLLGMPEQQELQEPPEAKRGSSSQKGNGSVCPQLLEPHRST

SEQ ID NO: 2841 - protein, 255 aa, Homo sapiens
MESRDPAQPMSPGEATQSGARPADRYGLLKHSREFLDFFWDIAKPEQETRLAATEKLLEYLRGRPKGSEMKYALKRLITGLGVGRETARPCYSLALAQLLQSFEDLPLCSILQQIQEKYDLHQVKKAMLRPALFANLFGVLALFQSGRLVKDQEALMKSVKLLQALAQYQNHLQEQPRKALVDILSEVSKATLQEILPEVLKADLNIILSSPEQLELFLLAQQKVPSKLKKLVGSVNLFSDENVPRLVNVLKMAA

SEQ ID NO: 2842 - protein, 255 aa, Homo sapiens
MLLPSLSPRVQPAFTQCARPQPPPHAPSPVGGRRGVFASSRHATTGTRGKMAAAVLSGPSAGSAAGVPGGTGGLSAVSSGPRLRLLLLESVSGLLQPRTGSAVAPVHPPNRSAPHLPGLMCLLRLHGSVGGAQNLSALGALVSLSNARLSSIKTRFEGLCLLSLLVGESPTELFQQHCVSWLRSIQQVLQTQDPPATMELAVAVLRDLLRYAAQLPALFRDISMNHLPGLLTSLLGLRPECEQSALEGMKACMTY

SEQ ID NO: 2843 - protein, 140 aa, Homo sapiens
MAGWNAYIDNLMADGTCQDAAIVGYKDSPSVWAAVPGKTFVNITPAEVGVLVGKDRSSFYVNGLTLGGQKCSVIRDSLLQDGEFSMDLRTKSTGGAPTFNVTVTKTDKTLVLLMGKEGVHGGLINKKCYEMASHLRRSQY

SEQ ID NO: 2844 - protein, 255 aa, Homo sapiens
MEPPGPVRGPLQDSSWYEPSAELVQTRMAVSLTAAETLALQGTQGQEKMMMMGPKEEEQSCEYETRLPGNHSTSQEIFRQRFRHLRYQETPGPREALSQLRVLCCEWLRPEKHTKEQILEFLVLEQFLTILPEELQSWVRGHHPKSGEEAVTVLEDLEKGLEPEPQVPGPAHGPAQEEPWEKKESLGAAQEALSIQLQPKETQPFPKSEQVYLHFLSVVTEDGPEPKDKGSLPQPPITEVESQVFSEKLATDTST

SEQ ID NO: 2845 - protein, 255 aa, Homo sapiens
MPEEAGFPPAKRFRPGSGPPSRAGSFPPGRQVVMLLTAGSGGRGGGGGRRQQPPLAQPSASPYPEAVELQRRSLPIFQARGQLLAQLRNLDNAVLIGETGSGKTTQIPQYLYEGGISRQGIIAVTQPRRVAAISLATRVSDEKRTELGKLVGYTVRFDDVTSEDTRIKFLTDGMLLREAISDSLLRKYSCVILDEAHERTIHTDVLFGVVKAAQKRRKELGKLPLKVIVMSATMDVDLFSQYFNGAPVLYLEGRQ

SEQ ID NO: 2846 - protein, 205 aa, Homo sapiens
MSVDPMTYEAQFFGFTPQTCMLRIYIAFQDYLFEVMQAVEQVILKKLDGIPDCDISPVQIRKCTEKFLCFMKGHFDNLFSKMEQLFLQLILRIPSNILLPEDKCKETPYSEEDFQHLQKEIEQLQEKYKTELCTKQALLAELEEQKIVQAKLKQTLTFFDELHNVGRDHGTSDFRESLVSLVQNSRKLQNIRDNVEKESKRLKIS

SEQ ID NO: 2847 - protein, 255 aa, Homo sapiens
MAGGAWGRLACYLEFLKKEELKEFQLLLANKAHSRSSSGETPAQPEKTSGMEVASYLVAQYGEQRAWDLALHTWEQMGLRSLCAQAQEGAGHSPSFPYSPSEPHLGSPSQPTSTAVLMPWIHELPAGCTQGSERRVLRQLPDTSGRRWREISASLLYQALPSSPDHESPSQESPNAPTSTAVLGSWGSPPQPSLAPREQEAPGTQWPLDETSGIYYTEIREREREKSEKGRPPWAAVVGTPPQAHTSLQPHHHPW

SEQ ID NO: 2848 - protein, 255 aa, Homo sapiens
MAKDFQDIQQLSSEENDHPFHQGEGPGTRRLNPRRGNPFLKGPPPAQPLAQRLCSMVCFSLLALSFNILLLVVICVTGSQSEGHRGAQLQAELRSLKEAFSNFSSSTLTEVQAISTHGGSVGDKITSLGAKLEKQQQDLKADHDALLFHLKHFPVDLRFVACQMELLHSNGSQRTCCPVNWVEHQGSCYWFSHSGKAWAEAEKYCQLENAHLVVINSWEEQKFIVQHTNPFNTWIGLTDSDGSWKWVDGTDYRHN

SEQ ID NO: 2849 - protein, 255 aa, Homo sapiens
MAAGSGGSGGSGGGPGPGPGGGGGPSGSGSGPGSNGGLGSGGELHPRTGRLVSLSACGRTARRQQPGQEFNHGLVLSREPLRDGRVFTVRIDRKVNSWSGSIEIGVTALDPSVLDFPSSATGLKGGSWVVSGCSVLRDGRSVLEEYGQDLDQLGEGDRVGVERTVAGELRLWVNGRDCGVAATGLPPRVWAVVDLYGKCTQITVLPPEPGFSPPTPIPTPPLEPLAPTEDSALAEQGTSADEAFMVSPAQARPET

SEQ ID NO: 2850 - protein, 255 aa, Homo sapiens
MPPPAEVTDPSHAPAVLRQLNEQRLRGLFCDVTLIAGDTKFPAHRSVLAASSPFFREALLTSAPLPLPPATGGAAPNPATTTAASSSSSSSSSSSSSSSSASSSSSSSSSSPPPASPPASSPPRVLELPGVPAAAFSDVLNFIYSARLALPGGGGDGAAVAEIGALGRRLGISRLQGLGEGGDAWVPPTPAPMATSQPEEDSFGPGPRPAGEWEGDRAEAQAPDLQCSLPRRPLPCPQCGKSFIHPKRLQTHEAQ

SEQ ID NO: 2851 - protein, 45 aa, Homo sapiens
GNLLGRNSFEVLVCACPGRDRRTEEENLRKKGEPHHELPPGSTKR

SEQ ID NO: 2852 - protein, 116 aa, Homo sapiens
MSATAATAPPAAPAGEGGPPAPPPNLTSNRRLQQTQAQVDEVVDIMRVNVDKVLERDQKLSELDDRADALQAGASQFETSAAKLKRKYWWKNLKMMIILGVICAIILIIIIVYFST

SEQ ID NO: 2853 - protein, 255 aa, Homo sapiens
MQPGATTCTEDRIQHALERCLHGLSLSRRSTSWSAGLCLNCWSLQELVSRDPGHFLILLEQILQKTREVQEKGTYDLLTPLALLFYSTVLCTPHFPPDSDLLLKAASTYHRFLTWPVPYCSICQELLTFIDAELKAPGISYQRLVRAEQGLPIRSHRSSTVTVLLLNPVEVQAEFLAVANKLSTPGHSPHSAYTTLLLHAFQATFGAHCDVPGLHCRLQAKTLAELEDIFTETAEAQELASGIGDAAEARRWLRT

SEQ ID NO: 2854 - protein, 255 aa, Homo sapiens
MWALCSLLRSAAGRTMSQGRTISQAPARRERPRKDPLRHLRTREKRGPSGCSGGPNTVYLQVVAAGSRDSGAALYVFSEFNRYLFNCGEGVQRLMQEHKLKVARLDNIFLTRMHWSNVGGLSGMILTLKETGLPKCVLSGPPQLEKYLEAIKIFSGPLKGIELAVRPHSAPEYEDETMTVYQIPIHSEQRRGKHQPWQSPERPLSRLSPERSSDSESNENEPHLPHGVSQRRGVRDSSLVVAFICKLHLKRGNFL

SEQ ID NO: 2855 - protein, 255 aa, Homo sapiens
MSSSGYPPNQGAFSTEQSRYPPHSVQYTFPNTRHQQEFAVPDYRSSHLEVSQASQLLQQQQQQQLRRRPSLLSEFHPGSDRPQERRTSYEPFHPGPSPVDHDSLESKRPRLEQVSDSHFQRVSAAVLPLVHPLPEGLRASADAKKDPAFGGKHEAPSSPISGQPCGDDQNASPSKLSKEELIQSMDRVDREIAKVEQQILKLKKKQQQLEEEAAKPPEPEKPVSPPPVEQKHRSIVQIIYDENRKKAEEAHKIFE

SEQ ID NO: 2856 - protein, 255 aa, Homo sapiens
MLASSKRMNSSSRSQILLRWKSDKAQSGPYNVEKEILTSRFLRDTETCRQNFRNFPYPDLAGPRKALSQLRELCLKWLRPEIHSKEQILELLVLEQFLTILPGEVRTWVKSQYPESSEEAVTLVEDLTQILEEEAPQNSTLSQDTPEEDPRGKHAFQTGWLNDLVTKESMTFKDVAVDITQEDWELMRPVQKELYKTVTLQNYWNMVSLGLTVYRPTVIPILEEPWMVIKEILEGPSPEWETKAQACTPVEDMSK

SEQ ID NO: 2857 - protein, 255 aa, Homo sapiens
MEFLLGNPFSTPVGQCLEKATDGSLQSEDWTLNMEICDIINETEEGPKDAIRALKKRLNGNRNYREVMLALTVLETCVKNCGHRFHILVANRDFIDSVLVKIISPKNNPPTIVQDKVLALIQAWADAFRSSPDLTGVVHIYEELKRKGVEFPMADLDALSPIHTPQRSVPEVDPAATMPRSQSQQRTSAGSYSSPPPAPYSAPQAPALSVTGPITANSEQIARLRSELDVVRGNTKVMSEMLTEMVPGQEDSSDL

SEQ ID NO: 2858 - protein, 118 aa, Homo sapiens
MESVALYSFQATESDELAFNKGDTLKILNMEDDQNWYKAELRGVEGFIPKNYIRVKPHPWYSGRISRQLAEEILMKRNHLGAFLIRESESSPGEFSVSVNNRAQRGPCLGPKSHSRLG

SEQ ID NO: 2859 - protein, 255 aa, Homo sapiens
MPHSYPALSAEQKKELSDIALRIVAPGKGILAADESVGSMAKRLSQIGVENTEENRRLYRQVLFSADDRVKKCIGGVIFFHETLYQKDDNGVPFVRTIQDKGIVVGIKVDKGVVPLAGTDGETTTQGLDGLSERCAQYKKDGADFAKWRCVLKISERTPSALAILENANVLARYASICQQNGIVPIVEPEILPDGDHDLKRCQYVTEKVLAAVYKALSDHHVYLEGTLLKPNMVTPGHACPIKYTPEEIAMATVT

SEQ ID NO: 2860 - protein, 211 aa, Homo sapiens
MAVVPLLLLGGLWSAVGASSLGVVTCGSVVKLLNTRHNVRLHSHDVRYGSGSGQQSVTGVTSVDDSNSYWRIRGKSATVCERGTPIKCGQPIRLTHVNTGRNLHSHHFTSPLSGNQEVSAFGEEGEGDYLDDWTVLCNGPYWVRDGEVRFKHSSTEVLLSVTGEQYGRPISGQKEVHGMAQPSQNNYWKAMEGIFMKPSELLKAEAHHAEL

SEQ ID NO: 2861 - protein, 255 aa, Homo sapiens
MNILAPVRRDRVLAELPQCLRKEAALHGHKDFHPRVTCACQEHRTGTVGFKISKVIVVGDLSVGKTCLINRFCKDTFDKNYKATIGVDFEMERFEVLGIPFSLQLWDTAGQERFKCIASTYYRGAQAIIIVFNLNDVASLEHTKQWLADALKENDPSSVLLFLVGSKKDLSTPAQYALMEKDALQVAQEMKAEYWAVSSLTGENVREFFFRVAALTFEANVLAELEKSGARRIGDVVRINSDDSNLYLTASKKKP

SEQ ID NO: 2862 - protein, 255 aa, Homo sapiens
MWEKMETKTIVYDLDTSGGLMEQIQALLAPPKTDEAEKRSRKPEKEPRRSGRATNHDSCDSCKEGGDLLCCDHCPAAFHLQCCNPPLSEEMLPPGEWMCHRCTVRRKKREQKKELGHVNGLVDKSGKRTTSPSSDTDLLDRSASKTELKAIAHARILERRASRPGTPTSSASTETPTSEQNDVDEDIIDVDEEPVAAEPDYVQPQLRRPFELLIAAAMERNPTQFQLPNELTCTTALPGSSKRRRKEETTGKNVK

SEQ ID NO: 2863 - protein, 255 aa, Homo sapiens
MEEKPGQPQPQHHHSHHHPHHHPQQQQQQPHHHHHYYFYNHSHNHHHHHHHQQPHQYLQHGAEGSPKAQPKPLKHEQKHTLQQHQETPKKKTGYGELNGNAGEREISLKNLSSDEATNPISRVLNGNQQVVDTSLKQTVKANTFGKAGIKTKNFIQKNSMDKKNGKSYENKSGENQSVDKSDTIPIPNGVVTNNSGYITNGYMGKGADNDGSGSESGYTTPKKRKARRNSAKGCENLNIVQDKIMQQETSVPTLK

SEQ ID NO: 2864 - protein, 255 aa, Homo sapiens
MEYQILKMSLCLFILLFLTPGILCICPLQCICTERHRHVDCSGRNLSTLPSGLQENIIHLNLSYNHFTDLHNQLTQYTNLRTLDISNNRLESLPAHLPRSLWNMSAANNNIKLLDKSDTAYQWNLKYLDVSKNMLEKVVLIKNTLRSLEVLNLSSNKLWTVPTNMPSKLHIVDLSNNSLTQILPGTLINLTNLTHLYLHNNKFTFIPDQSFDQLFQLQEITLYNNRWSCDHKQNITYLLKWMMETKAHVIGTPCS

SEQ ID NO: 2865 - protein, 255 aa, Homo sapiens
MDPKYFILILFCGHLNNTFFSKTETITTEKQSQPTLFTSSMSQVLANSQNTTGNPLGQPTQFSDTFSGQSISPAKVTAGQPTPAVYTSSEKPEAHTSAGQPLAYNTKQPTPIANTSSQQAVFTSARQLPSARTSTTQPPKSFVYTFTQQSSSVQIPSRKQITVHNPSTQPTSTVKNSPRSTPGFILDTTSNKQTPQKNNYNSIAAILIGVLLTSMLVAIIIIVLWKCLRKPVLNDQNWAGRSPFADGETPDICMD

SEQ ID NO: 2866 - protein, 163 aa, Homo sapiens
MRIEKCYFCSGPIYPGHGMMFVRNDCKVFRFCKSKCHKNFKKKRNPRKVRWTKAFRKAAGKELTVDNSFEFEKRRNEPIKYQRELWNKTIDAMKRVEEIKQKRQAKFIMNRLKKNKELQKVQDIKEVKQNIHLIRAPLAGKGKQLEEKMVQQLQEDVDMEDAP

SEQ ID NO: 2867 - protein, 570 aa, Homo sapiens
MAYEKSTDISDVSRSMFLYPWLEYPDKTKELRKAMAPVHLPLSCYQMPKEEFPPSPECWRQHPSKPNSVPYCYFKKPEIYTHWHDLYDQREEREAEKMLRKMRDDCRYIKEVHQTHIKMFHLPMSKLTIKSEMRSRPLEPTQDPLKWQRLRELTKSLESPREDEQFYAAQALGCLRISDKFVMEALQQVAQTGPEKVKYEAYRTLAILGCLNKHVIRALIKQLKEKNEGQRMETLTGLRMALNSWAAVSKDKRTQVGDEGKLVPVLQTLIKKSSSEASLEAALCLGFLRPCSNMVQEFLLQCLCQGLKTQRMKALRMLVKVMHVHSAPVIKAILDQLCSSSVLEDRFEATQMLKTIGLEQIQAQGLEELTFNLLRRKTHNEPFLAVRQAVAQTVEELKLKPTMMNLVEAQLMNPDATARQEAVISLGVLGIRSPQVFHLLLDLLDAENHQAVKKSLQETLILCASIDPWIQNKLKNKVLSVYEAPKTNVKAEPTRFQKEPENPEELTIQDFRLAKLNPLFIAKSITKVGQKKTPAFPPCCSKPRKHRPQVIGPWQPRIKKQLRVLAEIAK

SEQ ID NO: 2868 - protein, 255 aa, Homo sapiens
MRGELWLLVLVLREAARALSPQPGAGHDEGPGSGWAAKGTVRGWNRRARESPGHVSEPDRTQLSQDLGGGTLAMDTLPDNRTRVVEDNHSYYVSRLYGPSEPHSRELWVDVAEANRSQVKIHTILSNTHRQASRVVLSFDFPFYGHPLRQITIATGGFIFMGDVIHRMLTATQYVAPLMANFNPGYSDNSTVVYFDNGTVFVVQWDHVYLQGWEDKGSFTFQAALHHDGRIVFAYKEIPMSVPEISSSQHPVKTG

SEQ ID NO: 2869 - protein, 255 aa, Homo sapiens
MVQKTSMSRGPYPPSQEIPMEVFDPSPQGKYSKRKGRFKRSDGSTSSDTTSNSFVRQGSAESYTSRPSDSDVSLEEDREALRKEAERQALAQLEKAKTKPVAFAVRTNVGYNPSPGDEVPVQGVAITFEPKDFLHIKEKYNNDWWIGRLVKEGCEVGFIPSPVKLDSLRLLQEQKLRQNRLGSSKSGDNSSSSLGDVVTGTRRPTPPASGNEMTNLAFELDPLELEEEEAELGEQSGSAKTSVSSVTTPPPHGKR

SEQ ID NO: 2870 - protein, 255 aa, Homo sapiens
MAGLAARLVLLAGAAALASGSQGDREPVYRDCVLQCEEQNCSGGALNHFRSRQPIYMSLAGWTCRDDCKYECMWVTVGLYLQEGHKVPQFHGKWPFSRFLFFQEPASAVASFLNGLASLVMLCRYRTFVPASSPMYHTCVAFAWVSLNAWFWSTVFHTRDTDLTEKMDYFCASTVILHSIYLCCVRTVGLQHPAVVSAFRALLLLMLTVHVSYLSLIRFDYGYNLVANVAIGLVNVVWWLAWCLWNQRRLPHVRK

SEQ ID NO: 2871 - protein, 255 aa, Homo sapiens
MKVVNLKQAILQAWKERWSDYQWAINMKKFFPKGATWDILNLADALLEQAMIGPSPNPLILSYLKYAISSQMVSYSSVLTAISKFDDFSRDLCVQALLDIMDMFCDRLSCHGKAEECIGLCRALLSALHWLLRCTAASAERLREGLEAGTPAAGEKQLAMCLQRLEKTLSSTKNRALLHIAKLEEASSWTAIEHSLLKLGEILANLSNPQLRSQAEQCGTLIRSIPTMLSVHAEQMHKTGFPTVHAVILLEGTMN

SEQ ID NO: 2872 - protein, 255 aa, Homo sapiens
MTTLDSNNNTGGVITYIGSSGSSPSRTSPESLYSDNSNGSFQSLTQGCPTYFPPSPTGSLTQDPARSFGSIPPSLSDDGSPSSSSSSSSSSSSFYNGSPPGSLQVAMEDSSRVSPSKSTSNITKLNGMVLLCKVCGDVASGFHYGVHACEGCKGFFRRSIQQNIQYKRCLKNENCSIVRINRNRCQQCRFKKCLSVGMSRDAVRFGRIPKREKQRMLAEMQSAMNLANNQLSSQCPLETSPTQHPTPGPMGPSPP

SEQ ID NO: 2873 - protein, 255 aa, Homo sapiens
MDLGKPMKSVLVVALLVIFQVCLCQDEVTDDYIGDNTTVDYTLFESLCSKKDVRNFKAWFLPIMYSIICFVGLLGNGLVVLTYIYFKRLKTMTDTYLLNLAVADILFLLTLPFWAYSAAKSWVFGVHFCKLIFAIYKMSFFSGMLLLLCISIDRYVAIVQAVSAHRHRARVLLISKLSCVGIWILATVLSIPELLYSDLQRSSSEQAMRCSLITEHVEAFITIQVAQMVIGFLVPLLAMSFCYLVIIRTLLQARN

SEQ ID NO: 2874 - protein, 255 aa, Homo sapiens
MAVWIQAQQLQGEALHQMQALYGQHFPIEVRHYLSQWIESQAWDSVDLDNPQENIKATQLLEGLVQELQKKAEHQVGEDGFLLKIKLGHYATQLQNTYDRCPMELVRCIRHILYNEQRLVREANNGSSPAGSLADAMSQKHLQINQTFEELRLVTQDTENELKKLQQTQEYFIIQYQESLRIQAQFGPLAQLSPQERLSRETALQQKQVSLEAWLQREAQTLQQYRVELAEKHQKTLQLLRKQQTIILDDELIQW

SEQ ID NO: 2875 - protein, 255 aa, Homo sapiens
MAEAEGVPTTPGPASGSTFRGRRDVSGSWERDQQVEAAQRALVEVLGPYEPLLSRVQAALVWERPARSALWCLGLNAAFWFFALTSLRLVFLLAFGLMIIVCIDQWKNKIWPEIKVPRPDALDNESWGFVHPRLLSVPELCHHVAEVWVSGTIFIRNVLLFKKQNPGKFCLLSCGILTFLAVLGRYVPGLLLSYLMLVTVMMWPLAVYHRLWDRAYVRLKPALQRLDFSVRGYMMSKQRERQLRRRALHPERAMD

SEQ ID NO: 2876 - protein, 255 aa, Homo sapiens
MSDEREVAEAATGEDASSPPPKTEAASDPQHPAASEGAAAAAASPPLLRCLVLTGFGGYDKVKLQSRPAAPPAPGPGQLTLRLRACGLNFADLMARQGLYDRLPPLPVTPGMEGAGVVIAVGEGVSDRKAGDRVMVLNRSGMWQEEVTVPSVQTFLIPEAMTFEEAAALLVNYITAYMVLFDFGNLQPGHSVLVHMAAGGVGMAAVQLCRTVENVTVFGTASASKHEALKENGVTHPIDYHTTDYVDEIKKISPK

SEQ ID NO: 2877 - protein, 185 aa, Homo sapiens
MSGSFELSVQDLNDLLSDGSGCYSLPSQPCNEVTPRIYVGNASVAQDIPKLQKLGITHVLNAAEGRSFMHVNTNANFYKDSGITYLGIKANDTQEFNLSAYFERAADFIDQALAQKNGRVLVHCREGYSRSPTLVIAYLMMRQKMDVKSALSIVRQNREIGPNDGFLAQLCQLNDRLAKEGKLKP

SEQ ID NO: 2878 - protein, 193 aa, Homo sapiens [sequence omitted]

SEQ ID NO: 2879 - protein, 313 aa, Homo sapiens
MNGEADCPTDLEMAAPKGQDRWSQEDMLTLLECMKNNLPSNDSSKFKTTESHMDWEKVAFKDFSGDMCKLKWVEISNEVRKFRTLTELILDAQEHVKNPYKGKKLKKHPDFPKKPLTPYFRFFMEKRAKYAKLHPEMSNLDLTKILSKKYKELPEKKKMKYIQDFQREKQEFERNLARFREDHPDLIQNAKKSDIPEKPKTPQQLWYTHEKKVYLKVRPDEIMRDYIQKHPELNISEEGITKSTLTKAERQLKDKFDGRPTKPPPNSYSLYCAELMANMKDVPSTERMVLCSQQWKLLSQKEKDAYHKKCDQK

SEQ ID NO: 2880 - protein, 1424 aa, Homo sapiens
MGMGRMEMELDYAEDATERRRVLEVEKEDTEELRQKYKDYVDKEKAIAKALEDLRANFYCELCDKQYQKHQEFDNHINSYDHAHKQRLKDLKQREFARNVSSRSRKDEKKQEKALRRLHELAEQRKQAECAPGSGPMFKPTTVAVDEEGGEDDKDESATNSGTGATASCGLGSEFSTDKGGPFTAVQITNTTGLAQAPGLASQGISFGIKNNLGTPLQKLGVSFSFAKKAPVKLESIASVFKDHAEEGTSEDGTKPDEKSSDQGLQKVGDSDGSSNLDGKKEDEDPQDGGSLASTLSKLKRMKREEGAGATEPEYYHYIPPAHCKVKPNFPFLLFMRASEQMDGDNTTHPKNAPESKKGSSPKPKSCIKAAASQGAEKTVSEVSEQPKETSMTEPSEPGSKAEAKKALGGDVSDQSLESHSQKVSETQMCESNSSKETSLATPAGKESQEGPKHPTGPFFPVLSKDESTALQWPSELLIFTKAEPSISYSCNPLYFDFKLSRNKDARTKGTEKPKDIGSSSKDHLQGLDPGEPNKSKEVGGEKIVRSSGGRMDAPASGSACSGLNKQEPGGSHGSETEDTGRSLPSKKERSGKSHRHKKKKKHKKSSKHKRKHKADTEEKSSKAESGEKSKKRKKRKRKKNKSSAPADSERGPKPEPPGSGSPAPPRRRRRAQDDSQRRSLPAEEGSSGKKDEGGGGSSSQDHGGRKHKGELPPSSCQRRAGTKRSSRSSHRSQPSSGDEDSDDASSHRLHQKSPSQYSEEEEEEDSGSEHSRSRSRSGRRHSSHRSSRRSYSSSSDASSDQSCYSRQRSYSDDSYSDYSDRSRRHSKRSHDSDDSDYASSKHRSKRHKYSSSDDDYSLSCSQSRSRSRSHTRERSRSRGRSRSSSCSRSRSKRRSRSTTAHSWQRSRSYSRDRSRSTRSPSQRSGSRKRSWGHESPEERHSGRRDFIRSKIYRSQSPHYFRSGRGEGPGKKDDGRGDDSKATGPPSQNSNIGTGRGSEGDCSPEDKNSVTAKLLLEKIQSRKVERKPSVSEEVQATPNKAGPKLKDPPQGYFGPKLPPSLGNKPVLPLIGKLPATRKPNKKCEESGLERGEEQEQSETEEGPPGSSDALFGHQFPSEETTGPLLDPPPEESKSGEATADHPVAPLGTPAHSDCYPGDPTISHNYLPDPSDGDTLESLDSSSQPGPVESSLLPIAPDLEHFPSYAPPSGDPSIESTDGAEDASLAPLESQPITFTPEEMEKYSKLQQAAQQHIQQQLLAKQVKAFPASAALAPATPALQPIHIQQPATASATSITTVQHAILQHHAAAAAAAIGIHPHPHPQPLAQVHHIPQPHLTPISLSHLTHSIIPGHPATFLASHPIHIIPASAIHPGPFTFHPVPHAALYPTLLAPRPAAAAATALHLHPLLHPIFSGQDLQHPPSHGT

SEQ ID NO: 2881 - protein, 255 aa, Homo sapiens
MAVMEMACPGAPGSAVGQQKELPKAKEKTPPLGKKQSSVYKLEAVEKSPVFCGKWEILNDVITKGTAKEGSEAGPAAISIIAQAECENSQEFSPTFSERIFIAGSKQYSQSESLDQIPNNVAHATEGKMARVCWKGKRRSKARKKRKKKSSKSLAHAGVALAKPLPRTPEQESCTIPVQEDESPLGAPYVRNTPQFTKPLKEPGLGQLCFKQLGEGLRPALPRSELHKLISPLQCLNHVWKLHHPQDGGPLPLPT

SEQ ID NO: 2882 - protein, 255 aa, Homo sapiens
MDFQERDPPFLPESAQSSKPSSAQQASELWEVVEEPRVRLGTEGVMPERQEGHLLKKRKWPLKGWHKRYFVLEDGILHYATTRQDITKGKLHGSIDVRLSVMSINKKAQRIDLDTEDNIYHLKIKSQDLFQSWVAQLRAHRLAHRLDMPRGSLPSTAHRKVPGAQLPTAATASALPGLGPREKVSSWLRDSDGLDRCSHELSECQGKLQELHRLLQSLESLHRIPSAPVIPTHQASVTTERPKKGKRTSRMWCTQ

SEQ ID NO: 2883 - protein, 255 aa, Homo sapiens
MRPLPPVGDVRLELSPPPPLLPVPVVSGSPVGSSGRLMASSSSLVPDRLRLPLCFLGVFVCYFYYGILQEKITRGKYGEGAKQETFTFALTLVFIQCVINAVFAKILIQFFDTARVDRTRSWLYAACSISYLGAMVSSNSALQFVNYPTQVLGKSCKPIPVMLLGVTLLKKKYPLAKYLCVLLIVAGVALFMYKPKKVVGIEEHTVGYGELLLLLSLTLDGLTGVSQDHMRAHYQTGSNHMMLNINLWSTLLLGM

SEQ ID NO: 2884 - protein, 206 aa, Homo sapiens
MPISDPASSVSSSPSPPFGHSAAVSPTFMPRSTQPLTFTTATFAATKFGSTKMKNSGRSNKVARTSPINLGLNVNDLLKQKAISSSMHSLYGLGLGSQQQPQQQQQPAQPPPPPPPPQQQQQQKTSALSPNAKEFIFPNMQGQGSSTNGMFPGDSPLNLSPLQYSNAFDVFAAYGGLNEKSFVDGLNFSLNNMQYSNQQFQPVMAN

SEQ ID NO: 2885 - protein, 255 aa, Homo sapiens
MAFGKSHRDPYATSVGHLIEKATFAGVQTEDWGQFMHICDIINTTQDGPKDAVKALKKRISKNYNHKEIQLTLSLIDMCVQNCGPSFQSLIVKKEFVKENLVKLLNPRYNLPLDIQNRILNFIKTWSQGFPGGVDVSEVKEVYLDLVKKGVQFPPSEAEAETARQETAQISSNPPTSVPTAPALSSVIAPKNSTVTLVPEQIGKLHSELDMVKMNVRVMSAILMENTPGSENHEDIELLQKLYKTGREMQERIMD

SEQ ID NO: 2886 - protein, 255 aa, Homo sapiens
MEANWTAFLFQAHEASHHQQQAAQNSLLPLLSSAVEPPDQKPLLPIPITQKPQGAPETLKDAIGIKKEKPKTSFVCTYCSKAFRDSYHLRRHESCHTGIKLVSRPKKTPTTVVPLISTIAGDSSRTSLVSTIAGILSTVTTSSSGTNPSSSASTTAMPVTQSVKKPSKPVKKNHACEMCGKAFRDVYHLNRHKLSHSDEKPFECPICNQRFKRKDRMTYHVRSHEGGITKPYTCSVCGKGFSRPDHLSCHVKHVH

SEQ ID NO: 2887 - protein, 201 aa, Homo sapiens
MSGGGVIRGPAGNNDCRIYVGNLPPDIRTKDIEDVFYKYGAIRDIDLKNRRGGPPFAFVEFEDPRDAEDAVYGRDGYDYDGYRLRVEFPRSGRGTGRGGGGGGGGGAPRGRYGPPSRRSENRVVVSGLPPSGSWQDLKDHMREAGDVCYADVYRDGTGVVEFVRKEDMTYAVRKLDNTKFRSHEVGYTRILFFDQNWIQWS

SEQ ID NO: 2888 - protein, 478 aa, Homo sapiens
MDRSLGWQGNSVPEDRTEAGIKRFLEDTTDDGELSKFVKDFSGNASCHPPEAKTWASRPQVPEPRPQAPDLYDDDLEFRPPSRPQSSDNQQYFCAPAPLSPSARPRSPWGKLDPYDSSEDDKEYVGFATLPNQVHRKSVKKGFDFTLMVAGESGLGKSTLVNSLFLTDLYRDRKLLGAEERIMQTVEITKHAVDIEEKGVRLRLTIVDTPGFGDAVNNTECWKPVAEYIDQQFEQYFRDESGLNRKNIQDNRVHCCLYFISPFGHGLRPLDVEFMKALHQRVNIVPILAKADTLTPPEVDHKKRKIREEIEHFGIKIYQFPDCDSDEDEDFKLQDQALKESIPFAVIGSNTVVEARGRRVRGRLYPWGIVEVENPGHCDFVKLRTMLVRTHMQDLKDVTRETHYENYRAQCIQSMTRLVVKERNRNKLTRESGTDFPIPAVPPGTDPETEKLIREKDEELRRMQEMLHKIQKQMKENY

SEQ ID NO: 2889 - protein, 255 aa, Homo sapiens
MSASFVPNGASLEDCHCNLFCLADLTGIKWKKYVWQGPTSAPILFPVTEEDPILSSFSRCLKADVLGVWRRDQRPGRRELWIFWWGEDPSFADLIHHDLSEEEDGVWENGLSYECRTLLFKAVHNLLERCLMNRNFVRIGKWFVKPYEKDEKPINKSEHLSCSFTFFLHGDSNVCTSVEINQHQPVYLLSEEHITLAQQSNSPFQVILCPFGLNGTLTGQAFKMSDSATKKLIGEWKQFYPISCCLKEMSEEKQE

SEQ ID NO: 2890 - protein, 127 aa, Homo sapiens
MFQAAGAAQATPSHDAKGGGSSTVQRSKSFSLRAQVKETCAACQKTVYPMERLVADKLIFHNSCFCCKHCHTKLSLGSYAALHGEFYCKPHFQQLFKSKGNYDEGFGRKQHKELWAHKEVDPGTKTA

SEQ ID NO: 2891 - protein, 255 aa, Homo sapiens
MSFLTNDASSESIASFSKQEVMSSFLPEGGCYELLTVIGKGFEDLMTVNLARYKPTGEYVTVRRINLEACSNEMVTFLQGELHVSKLFNHPNIVPYRATFIADNELWVVTSFMAYGSAKDLICTHFMDGMNELAIAYILQGVLKALDYIHHMGYVHRSVKASHILISVDGKVYLSGLRSNLSMISHGQRQRVVHDFPKYSVKVLPWLSPEVLQQNLQGYDAKSDIYSVGITACELANGHVPFKDMPATQMLLEKL

SEQ ID NO: 2892 - protein, 255 aa, Homo sapiens
MGKKGKVGKSRRDKFYHLAKETGYRSRSAFKLIQLNRRFQFLQKARALLDLCAAPGGWLQVAAKFMPVSSLIVGVDLVPIKPLPNVVTLQQDITTERCRQALRKELKTWKVDVVLNDGAPNVGASWVHDAYSQAHLTLMALRLACDFLARGGSFITKVFRSRDYQPLLWIFQQLFRRVQATKPQASRHESAEIFVVCQGFLAPDKVDSKFFDPKFAFKEVEVQAKTVTELVTKKKPKAEGYAEGDLTLYHRTSVT

SEQ ID NO: 2893 - protein, 229 aa, Homo sapiens
MARLALSPVPSHWMVALLLLLSAEPVPAARSEDRYRNPKGSACSRIWQSPRFIARKRGFTVKMHCYMNSASGNVSWLWKQEMDENPQQLKLEKGRMEESQNESLATLTIQGIRFEDNGIYFCQQKCNNTSEVYQGCGTELRVMGFSTLAQLKQRNTLKDGIIMIQTLLIILFIIVPIFLLLDKDDSKAGMEEDHTYEGLDIDQTATYEDIVTLRTGEVKWSVGEHPGQE

SEQ ID NO: 2894 - protein, 98 aa, Homo sapiens
MASGAGGSWGRSPPQSAVPTPWVTFLQPLSWAVPPAPPQPGRVKEDLLELMMLQNAQMHQLLLSRLVAGALQPRPASPCPQESCAPTPTPQCHRDCGC

SEQ ID NO: 2895 - protein, 255 aa, Homo sapiens
MPARRLLLLLTLLLPGLGIFGSTSTVTLPETLLFVSTLDGSLHAVSKRTGSIKWTLKEDPVLQVPTHVEEPAFLPDPNDGSLYTLGSKNNEGLTKLPFTIPELVQASPCRSSDGILYMGKKQDIWYVIDLLTGEKQQTLSSAFADSLCPSTSLLYLGRTEYTITMYDTKTRELRWNATYFDYAASLPEDDVDYKMSHFVSNGDGLVVTVDSESGDVLWIQNYASPVVAFYVWQREGLRKVMHINVAVETLRYLTF

SEQ ID NO: 2896 - protein, 255 aa, Homo sapiens
MTSLYGRHAEKTTDMPKPSAPKVHVQRSVSRDTIAIHFSASGEEEEEEEEEFREYFEEGLDDQSIVTGLEAKEDLYLEPQVGHDPAGPAASPVLADGLSVSQAPAILPVSKNTVKLLESPVPAAQVLSTVPLAVSPGSSSSGPLASSPSVSSLSEQKTSSSSPLSSPSKSPILSSSASTSTLSSAKPFMSLVKSLSTEVEPKESPHPARHRHLMKTLVKSLSTDTSRQESDTVSYKPPDSKLNLHLFKQFTQPRN

SEQ ID NO: 2897 - protein, 255 aa, Homo sapiens
MTSAQCPALACVMSPLRFWGPWPLLMWQLLWLLVKEAQPLEWVKDPLQLTSNPLGPPEPWSSHSSHFPRESPHAPTLPADPWDFDHLGPSASSEMPAPPQESTENLVPFLDTWDSAGELPLEPEQFLASQQDLKDKLSPQERLPVSPKKLKKDPAQRWSLAEIIGIIHQLSTPQSQKQTLQNEYSSTDTPYPGSLPPELRVKSDEPPGPSEQVGPSQFHLEPETQNPETLEDIQSSSLQQEAPAQLPQLLEEEPS

SEQ ID NO: 2898 - protein, 255 aa, Homo sapiens
MADFLPSRSVLSVCFPGCLLTSGEAEQQRKSKEIDKCLSREKTYVKRLVKILLLGAGESGKSTFLKQMRIIHGQDFDQRAREEFRPTIYSNVIKGMRVLVDAREKLHIPWGDNSNQQHGDKMMSFDTRAPMAAQGMVETRVFLQYLPAIRALWADSGIQNAYDRRREFQLGESVKYFLDNLDKLGEPDYIPSQQDILLARRPTKGIHEYDFEIKNVPFKMVDVGGQRSERKRWFECFDSVTSILFLVSSSEFDQV

SEQ ID NO: 2899 - protein, 255 aa, Homo sapiens
MEAEAADAPPGGVESALSCFSFNQDCTSLATGTKAGYKLFSLSSVEQLDQVHGSNEIPDVYIVERLFSSSLVVVVSHTKPRQMNVYHFKKGTEICNYSYSSNILSIRLNRQRLLVCLEESIYIHNIKDMKLLKTLLDIPANPTGLCALSINHSNSYLAYPGSLTSGEIVLYDGNSLKTVCTIAAHEGTLAAITFNASGSKLASASEKGTVIRVFSVPDGQKLYEFRRGMKRYVTISSLVFSMDSQFLCASSNTET

SEQ ID NO: 2900 - protein, 255 aa, Homo sapiens
MYREQMNLTSLDPPLQLRLEASWVQFHLGINRHGLYSRSSPVVSKLLQDMRHFPTISADYSQDEKALLGACDCTQIVKPSGVHLKLVLRFSDFGKAMFKPMRQQRDEETPVDFFYFIDFQRHNAEIAAFHLDRILDFRRVPPTVGRIVNVTKEILEVTKNEILQSVFFVSPASNVCFFAKCPYMCKTEYAVCGNPHLLEGSLSAFLPSLNLAPRLSVPNPWIRSYTLAGKEEWEVNPLYCDTVKQIYPYNNSQRL

SEQ ID NO: 2901 - protein, 207 aa, Homo sapiens
MRLNQNTLLLGKKVVLVPYTSEHVPSRYHEWMKSEELQRLTASEPLTLEQEYAMQCSWQEDADKCTFIVLDAEKWQAQPGATEESCMVGDVNLFLTDLEDLTLGEIEVMIAEPSCRGKGLGTEAVLAMLSYGVTTLGLTKFEAKIGQGNEPSIRMFQKLHFEQVATSSVFQEVTLRLTVSESEHQWLLEQTSHVEEKPYRDGSAEPC

SEQ ID NO: 2902 - protein, 723 aa, Homo sapiens
MAEAEGESLESWLNKATNPSNRQEDWEYIIGFCDQINKELEGPQIAVRLLAHKIQSPQEWEALQALTVLEACMKNCGRRFHNEVGKFRFLNELIKVVSPKYLGDRVSEKVKTKVIELLYSWTMALPEEAKIKDAYHMLKRQGIVQSDPPIPVDRTLIPSPPPRPKNPVFDDEEKSKLLAKLLKSKNPDDLQEANKLIKSMVKEDEARIQKVTKRLHTLEEVNNNVRLLSEMLLHYSQEDSSDGDRELMKELFDQCENKRRTLFKLASETEDNDNSLGDILQASDNLSRVINSYKTIIEGQVINGEVATLTLPDSEGNSQCSNQGTLIDLAELDTTNSLSSVLAPAPTPPSSGIPILPPPPQASGPPRSRSSSQAEATLGPSSTSNALSWLDEELLCLGLADPAPNVPPKESAGNSQWHLLQREQSDLDFFSPRPGTAACGASDAPLLQPSAPSSSSSQAPLPPPFPAPVVPASVPAPSAGSSLFSTGVAPALAPKVEPAVPGHHGLALGNSALHHLDALDQLLEEAKVTSGLVKPTTSPLIPTTTPARPLLPFSTGPGSPLFQPLSFQSQGSPPKGPELSLASIHVPLESIKPSSALPVTAYDKNGFRILFHFAKECPPGRPDVLVVVVSMLNTAPLPVKSIVLQAAVPKSMKVKLQPPSGTELSPFSPIQPPAAITQVMLLANPLKEKVRLRYKLTFALGEQLSTEVGEVDQFPPVEQWGNL

SEQ ID NO: 2903 - protein, 136 aa, Homo sapiens
MARTKQTARKSTGGKAPRKQLATKAARKSAPSTGGVKKPHRYRPGTVALREIRRYQKSTELLIRKLPFQRLVREIAQDFKTDLRFQSAAIGALQEASEAYLVGLFEDTNLCAIHAKRVTIMPKDIQLARRIRGERA

SEQ ID NO: 2904 - protein, 255 aa, Homo sapiens
MIPPQEASARRREIEDKLKQEEETLSFIRDSLEKSDQLTKNMVSILSSFESRLMKLENSIIPVHKQTENLQRLQENVEKTLSCLDHVISYYHVASDTEKIIREGPTGRLEEYLGSMAKIQKAVEYFQDNSPDSPELNKVKLLFERGKEALESEFRSLMTRHSKVVSPVLILDLISGDDDLEAQEDVTLEHLPESVLQDVIRISRWLVEYGRNQDFMNVYYQIRSSQLDRSIKGLKEHFHKSSSSSGVPYSPAIPN

SEQ ID NO: 2905 - protein, 221 aa, Homo sapiens
MSYGRPPPDVEGMTSLKVDNLTYRTSPDTLRRVFEKYGRVGDVYIPRDRYTKESRGFAFVRFHDKRDAEDAMDAMDGAVLDGRELRVQMARYGRPPDSHHSRRGPPPRRYGGGGYGRRSRSPRRRRRSRSRSRSRSRSRSRSRYSRSKSRSRTRSRSRSTSKSRSARRSKSKSSSVSRSRSRSRSRSRSRSPPPVSKRESKSRSRSKSPPKSPEEEGAVSS

SEQ ID NO: 2906 - protein, 444 aa, Homo sapiens
MAHSFGESYRVGSTSGIHAITVFCSWDYKVTQKRASRLQQDNIRTRLKELLAEWQLRHSPRSVCGRLRQAAVLGLVWLLCLGTALGCAVAVHVFSEFMIQSPEAAGQEAVLLVLPLVVGLLNLGAPYLCRVLAALEPHDSPVLEVYVAICRNLILKLAILGTLCYHWLGRRVGVLQGQCWEDFVGQELYRFLVMDFVLMLLDTLFGELVWRIISEKKLKRRRKPEFDIARNVLELIYGQTLTWLGVLFSPLLPAVQIIKLLLVFYVKKTSLLANCQAPRRPWLASHMSTVFLTLLCFPAFLGAAVFLCYAVWQVKPSSTCGPFRTLDTMYEAGRVWVRHLEAAGPRVSWLPWVHRYLMENTFFVFLVSALLLAVIYLNIQVVRGQRKVICLLKEQISNEGEDKIFLINKLHSIYERKEREERSRVGTTEEAAAPPALLTDEQDA

SEQ ID NO: 2907 - protein, 255 aa, Homo sapiens
MPIVDKLKEALKPGRKDSADDGELGKLLASSAKKVLLQKIEFEPASKSFSYQLEALKSKYVLLNPKTEGASRHKSGDDPPARRQGSEHTYESCGDGVPAPQKVLFPTERLSLRWERVFRVGAGLHNLGNTCFLNATIQCLTYTPPLANYLLSKEHARSCHQGSFCMLCVMQNHIVQAFANSGNAIKPVSFIRDLKKIARHFRFGNQEDAHEFLRYTIDAMQKACLNGCAKLDRQTQATTLVHQIFGGYLRSRVKC

SEQ ID NO: 2908 - protein, 240 aa, Homo sapiens
MAGPPRLLLLPLLLALARGLPGALAAQEVQQSPHCTTVPVGASVNITCSTSGGLRGIYLRQLGPQPQDIIYYEDGVVPTTDRRFRGRIDFSGSQDNLTITMHRLQLSDTGTYTCQAITEVNVYGSGTLVLVTEEQSQGWHRCSDAPPRASALPAPPTGSALPDPQTASALPDPPAASALPAALAVISFLLGLGLGVACVLARTQIKKLCSWRDKNSAACVVYEDMSHSRCNTLSSPNQYQ

SEQ ID NO: 2909 - protein, 195 aa, Homo sapiens
MMAIRELKVCLLGDTGVGKSSIVCRFVQDHFDHNISPTIGASFMTKTVPCGNELHKFLIWDTAGQERFHSLAPMYYRGSAAAVIVYDITKQDSFYTLKKWVKELKEHGPENIVMAIAGNKCDLSDIREVPLKDAKEYAESIGAIVVETSAKNAINIEELFQGISRQIPPLDPHENGNNGTIKVEKPTMQASRRCC

SEQ ID NO: 2910 - protein, 255 aa, Homo sapiens
MASASGAMAKHEQILVLDPPTDLKFKGPFTDVVTTNLKLRNPSDRKVCFKVKTTAPRRYCVRPNSGIIDPGSTVTVSVMLQPFDYDPNEKSKHKFMVQTIFAPPNTSDMEAVWKEAKPDELMDSKLRCVFEMPNENDKLGITPPGNAPTVTSMSSINNTVATPASYHTKDDPRGLSVLKQEKQKNDMEPSKAVPLNASKQDGPMPKPHSVSLNDTETRKLMEECKRLQGEMMKLSEENRHLRDEGLRLRKVAHSD

SEQ ID NO: 2911 - protein, 255 aa, Homo sapiens
MFVARSIAADHKDLIHDVSFDFHGRRMATCSSDQSVKVWDKSESGDWHCTASWKTHSGSVWRVTWAHPEFGQVLASCSFDRTAAVWEEIVGESNDKLRGQSHWVKRTTLVDSRTSVTDVKFAPKHMGLMLATCSADGIVRIYEAPDVMNLSQWSLQHEISCKLSCSCISWNPSSSRAHSPMIAVGSDDSSPNAMAKVQIFEYNENTRKYAKAETLMTVTDPVHDIAFAPNLGRSFHILAIATKDVRIFTLKPVRK

SEQ ID NO: 2912 - protein, 73 aa, Homo sapiens
MTYFPLGRYPVVGLLDQMVVLSTFSSLKNLHIVFHSGCTSLHSHQLCKRVPFSPHPRQHLLFFDFWIKAILAE

SEQ ID NO: 2913 - protein, 255 aa, Homo sapiens
MANSAKAEEYEKMSLEQAKASVNSETESSFNINENTTASGTGLSEKTSVCRQVDIARKRKEFEDDLVKESSSCGKDTPSKKRKLDPEIVPEEKDCGDAEGNSKKRKRETEDVPKDKSSTGDGTQNKRKIALEDVPEKQKNLEEGHSSTVAAHYNELQEVGLEKRSQSRIFYLRNFNNWMKSVLIGEFLEKVRQKKKRDITVLDLGCGKGGDLLKWKKGRINKLVCTDIADVSVKQCQQRYEDMKNRRDSEYIFSA

SEQ ID NO: 2914 - protein, 245 aa, Homo sapiens
MAEDLSAATSYTEDDFYCPVCQEVLKTPVRTTACQHVFCRKCFLTAMRESGAHCPLCRGNVTRRERACPERALDLENIMRKFSGSCRCCAKQIKFYRMRHHYKSCKKYQDEYGVSSIIPNFQISQDSVGNSNRSETSTSDNTETYQENTSSSGHPTFKCPLCQESNFTRQRLLDHCNSNHLFQIVPVTCPICVSLPWGDPSQITRNFVSHLNQRHQFDYGEFVNLQLDEETQYQTAVEESFQVNI

SEQ ID NO: 2915 - protein, 255 aa, Homo sapiens
MRKFAYCKVVLATSLIWVLLDMFLLLYFSECNKCDEKKERGLPAGDVLEPVQKPHEGPGEMGKPVVIPKEDQEKMKEMFKINQFNLMASEMIALNRSLPDVRLEGCKTKVYPDNLPTTSVVIVFHNEAWSTLLRTVHSVINRSPRHMIEEIVLVDDASERDFLKRPLESYVKKLKVPVHVIRMEQRSGLIRARLKGAAVSKGQVITFLDAHCECTVGWLEPLLARIKHDRRTVVCPIIDVISDDTFEYMAGSDMT

SEQ ID NO: 2916 - protein, 255 aa, Homo sapiens
MVAPVLETSHVFCCPNRVRGVLNWSSGPRGLLAFGTSCSVVLYDPLKRVVVTNLNGHTARVNCIQWICKQDGSPSTELVSGGSDNQVIHWEIEDNQLLKAVHLQGHEGPVYAVHAVYQRRTSDPALCTLIVSAAADSAVRLWSKKGPEGRDLFLASCSQDCLIRIWKLYIKSTSLETQDDDNIRLKENTFTIENESVKIAFAVTLETVLAGHENWVNAVHWQPVFYKDGVLQQPVRLLSASMDKTMILWAPDEES

SEQ ID NO: 2917 - protein, 255 aa, Homo sapiens
MGEAEKFHYIYSCDLDINVQLKIGSLEGKREQKSYKAVLEDPMLKFSGLYQETCSDLYVTCQVFAEGKPLALPVRTSYKAFSTRWNWNEWLKLPVKYPDLPRNAQVALTIWDVYGPGKAVPVGGTTVSLFGKYGMFRQGMHDLKVWPNVEADGSEPTKTPGRTSSTLSEDQMSRLAKLTKAHRQGHMVKVDWLDRLTFREIEMINESEKRSSNFMYLMVEFRCVKCDDKEYGIVYYEKDGDESSPILTSFELVKV

SEQ ID NO: 2918 - protein, 255 aa, Homo sapiens
MSDPHSSPLLPEPLSSRYKLYEAEFTSPSWPSTSPDTHPALPLLEMPEEKDLRSSNEDSHIVKIEKLNERSKRKDDGVAHRDSAGQRCICLSKAVGYLTGDMKEYRIWLKDKHLALQFIDWVLRGTAQVMFINNPLSGLIIFIGLLIQNPWWTITGGLGTVVSTLTALALGQDRSAIASGLHGYNGMLVGLLMAVFSEKLDYYWWLLFPVTFTAMSCPVLSSALNSIFSKWDLPVFTLPFNIAVTLYLAATGHYN

SEQ ID NO: 2919 - protein, 255 aa, Homo sapiens
MLSRLRVVSTTCTLACRHLHIKEKGKPLMLNPRTNKGMAFTLQERQMLGLQGLLPPKIETQDIQALRFHRNLKKMTSPLEKYIYIMGIQERNEKLFYRILQDDIESLMPIVYTPTVGLACSQYGHIFRRPKGLFISISDRGHVRSIVDNWPENHVKAVVVTDGERILGLGDLGVYGMGIPVGKLCLYTACAGIRPDRCLPVCIDVGTDNIALLKDPFYMGLYQKRDRTQQYDDLIDEFMKAITDRYGRNTLIQFE

SEQ ID NO: 2920 - protein, 255 aa, Homo sapiens
MEDLCVANTLFALNLFKHLAKASPTQNLFLSPWSISSTMAMVYMGSRGSTEDQMAKVLQFNEVGANAVTPMTPENFTSCGFMQQIQKGSYPDAILQAQAADKIHSSFRSLSSAINASTGNYLLESVNKLFGEKSASFREEYIRLCQKYYSSEPQAVDFLECAEEARKKINSWVKTQTKGKIPNLLPEGSVDGDTRMVLVNAVYFKGKWKTPFEKKLNGLYPFRVNSAQRTPVQMMYLREKLNIGYIEDLKAQILE

SEQ ID NO: 2921 - protein, 255 aa, Homo sapiens
MMDSENKPENDEDEKINKEAQDLTKLSSHNEDGGPVSDVIASFPENSMGKRGFSESSNSDSVVIGEDRNKHASKRRKLDEAEPLKSGKQGICRLETSESSVTEGGIALDETGKETFLSDCTVGGTCLPNALSPSCNFSTIDVVSLKTDTEKTSAQEMVSLDLERESPFPPKEISVSCTIGNVDTVLKCSICGHLFSSCSDLEKHAESHMQQPKEHTCCHCSHKAESSSALHMHIKQAHGPQKVFSCDLCGFQCSE

SEQ ID NO: 2922 - protein, 255 aa, Homo sapiens
MGLCGLLERCWLHHDPDGVLTLNAENTNYAYQVPNFHKCEICLLSFPKESQFQRHMRDHERNDKPHRCDQCPQTFNVEFNLTLHKCTHSGEDPTCPVCNKKFSRVASLKAHIMLHEKEENLICSECGDEFTLQSQLAVHMEEHRQELAGTRQHACKACKKEFETSSELKEHMKTHYKIRVSSTRSYNRNIDRSGFTYSCPHCGKTFQKPSQLTRHIRIHTGERPFKCSECGKAFNQKGALQTHMIKHTGEKPHAC

SEQ ID NO: 2923 - protein, 255 aa, Homo sapiens
MLQLFIGTADDRLLRPHAFYQVHRITGKTVSTTSHEAILSNTKVLEIPLLPENSMRAVIDCAGILKLRNSDIELRKGETDIGRKNTRVRLVFRVHVPQPSGRTLSLQVASNPIECSQRSAQELPLVEKQSTDSYPVVGGKKMVLSGHNFLQDSKVIFVEKAPDGHHVWEMEAKTDRDLCKPNSLVVEIPPFRNQRITSPVHVSFYVCNGKRKRSQYQRFTYLPANVPIIKTEPTDDYEPAPTCGPVSQGLSPLPR

SEQ ID NO: 2924 - protein, 255 aa, Homo sapiens
MVRGRISRLSVRDVRFPTSLGGHGADAMHTDPDYSAAYVVIETDAEDGIKGCGITFTLGKGTEVVVCAVNALAHHVLNKDLKDIVGDFRGFYRQLTSDGQLRWIGPEKGVVHLATAAVLNAVWDLWAKQEGKPVWKLLVDMDPRMLVSCIDFRYITDVLTEEDALEILQKGQIGKKEREKQMLAQGYPAYTTSCAWLGYSDDTLKQLCAQALKDGWTRFKVKVGADLQDDMRRCQIIRDMIGPEKTLMMDANQRW

SEQ ID NO: 2925 - protein, 255 aa, Homo sapiens
MSLPFYQRCHQHYDLSYRNKDVRSTVSHYQREKKRSAVYTQGSTAYSSRSSAAHRRESEAFRRASASSSQQQASQHALSSEVSRKAASAYDYGSSHGLTDSSLLLDDYSSKLSPKPKRAKHSLLSGEEKENLPSDYMVPIFSGRQKHVSGITDTEEERIKEAAAYIAQRNLLASEEGITTSKQSTASKQTTASKQSTASKQSTASKQSTASRQSTASRQSVVSKQATSALQQEETSEKKSRKVVIREKAERLSLR

SEQ ID NO: 2926 - protein, 255 aa, Homo sapiens
MAHRCLRLWGRGGCWPRGLQQLLVPGGVGPGEQPCLRTLYRFVTTQARASRNSLLTDIIAAYQRFCSRPPKGFEKYFPNGKNGKKASEPKEVMGEKKESKPAATTRSSGGGGGGGGKRGGKKDDSHWWSRFQKGDIPWDDKDFRMFFLWTALFWGGVMFYLLLKRSGREITWKDFVNNYLSKGVVDRLEVVNKRFVRVTFTPGKTPVDGQYVWFNIGSVDTFERNLETLQQELGIEGENRVPVVYIAESDGSFLL

SEQ ID NO: 2927 - protein, 255 aa, Homo sapiens
MQRLAMDLRMLSRELSLYLEHQVRVGFFGSGVGLSLILGFSVAYAFYYLSSIAKKPQLVTGGESFSRFLQDHCPVVTETYYPTVWCWEGRGQTLLRPFITSKPPVQYRNELIKTADGGQISLDWFDNDNSTCYMDASTRPTILLLPGLTGTSKESYILHMIHLSEELGYRCVVFNNRGVAGENLLTPRTYCCANTEDLETVIHHVHSLYPSAPFLAAGVSMGGMLLLNYLGKIGSKTPLMAAATFSVGWNTFACS

SEQ ID NO: 2928 - protein, 255 aa, Homo sapiens
MNTEAEQQLLHHARNGNAEEVRQLLETMARNEVIADINCKGRSKSNLGWTPLHLACYFGHRQVVQDLLKAGAEVNVLNDMGDTPLHRAAFTGRKELVMLLLEYNADTTIVNGSGQTAKEVTHAEEIRSMLEAVERTQQRKLEELLLAAAREGKTTELTALLNRPNPPDVNCSDQLGNTPLHCAAYRAHKQCALKLLRSGADPNLKNKNDQKPLDLAQGAEMKHILVGNKVIYKALKRYEGPLWKSSRFFGWRLFW

SEQ ID NO: 2929 - protein, 255 aa, Homo sapiens
MCRIAGALRTLLPLLAALLQASVEASGEIALCKTGFPEDVYSAVLSKDVHEGQPLLNVKFSNCNGKRKVQYESSEPADFKVDEDGMVYAVRSFPLSSEHAKFLIYAQDKETQEKWQVAVKLSLKPTLTEESVKESAEVEEIVFPRQFSKHSGHLQRQKRDWVIPPINLPENSRGPFPQELVRIRSDRDKNLSLRYSVTGPGADQPPTGIFIINPISGQLSVTKPLDREQIARFHLRAHAVDINGNQVENPIDIVI

SEQ ID NO: 2930 - protein, 255 aa, Homo sapiens
MALASAAPGSIFCKQLLFSLLVLTLLCDACQKVYLRVPSHLQAETLVGKVNLEECLKSASLIRSSDPAFRILEDGSIYTTHDLILSSERKSFSIFLSDGQRREQQEIKVVLSARENKSPKKRHTKDTALKRSKRRWAPIPASLMENSLGPFPQHVQQIQSDAAQNYTIFYSISGPGVDKEPFNLFYIEKDTGDIFCTRSIDREKYEQFALYGYATTADGYAPEYPLPLIIKIEDDNDNAPYFEHRVTIFTVPENC

SEQ ID NO: 2931 - protein, 255 aa, Homo sapiens
MTRSLFKGNFWSADILSTIGYDNIIQHLNNGRKNCKEFEDFLKERAAIEERYGKDLLNLSRKKPCGQSEINTLKRALEVFKQQVDNVAQCHIQLAQSLREEARKMEEFREKQKLQRKKTELIMDAIHKQKSLQFKKTMDAKKNYEQKCRDKDEAEQAVSRSANLVNPKQQEKLFVKLATSKTAVEDSDKAYMLHIGTLDKVREEWQSEHIKACEAFEAQECERINFFRNALWLHVNQLSQQCVTSDEMYEQVRKS

SEQ ID NO: 2932 - protein, 76 aa, Homo sapiens
MVCIPCIVIPVLLWIYKKFLEPYIYPLVSPFVSRIWPKKAIQESNDTNKGKVNFKGADMNGLPTKGPTEICDKKKD

SEQ ID NO: 2933 - protein, 255 aa, Homo sapiens
MRAHPGGGRCCPEQEEGESAAGGSGAGGDSAIEQGGQGSALAPSPVSGVRREGARGGGRGRGRWKQAGRGGGVCGRGRGRGRGRGRGRGRGRGRGRPPSGGSGLGGDGGGCGGGGSGGGGAPRREPVPFPSGSAGPGPRGPRATESGKRMDCPALPPGWKKEEVIRKSGLSAGKSDVYYFSPSGKKFRSKPQLARYLGNTVDLSSFDFRTGKMMPSKLQKNKQRLRNDPLNQNKGKPDLNTTLPIRQTASIFKQP

SEQ ID NO: 2934 - protein, 255 aa, Homo sapiens
MLLFFTLGLLIHFVFFASIFDIYFTSPLVHGMTPQFTPLPPPARRLVLFVADGLRADALYELDENGNSRAPFIRNIIMHEGSWGISHTRVPTESRPGHVALIAGFYEDVSAVAKGWKENPVEFDSLFNESKYTWSWGSPDILPMFAKGASGDHVYTYSYDAKREDFGAQDATKLDTWVFDNVKDFFHHARNNQSLFSKINEEKIVFFLHLLGIDTNGHAHRPSSRDYKHNIKKVDDGVKEIVSMFNHFYGNDGKT

SEQ ID NO: 2935 - protein, 255 aa, Homo sapiens
MAAWKSWTALRLCATVVVLDMVVCKGFVEDLDESFKENRNDDIWLVDFYAPWCGHCKKLEPIWNEVGLEMKSIGSPVKVGKMDATSYSSIASEFGVRGYPTIKLLKGDLAYNYRGPRTKDDIIEFAHRVSGALIRPLPSQQMFEHMQKRHRVFFVYVGGESPLKEKYIDAASELIVYTYFFSASEEVVPEYVTLKEMPAVLVFKDETYFVYDEYEDGDLSSWINRERFQNYLAMDGFLLYELGDTGKLVALAVID

SEQ ID NO: 2936 - protein, 255 aa, Homo sapiens
MEAEGLDWLLVPLHQLVSWGAAAAMVFGGVVPYVPQYRDIRRTQNADGFSTYVCLVLLVANILRILFWFGRRFESPLLWQSAIMILTMLLMLKLCTEVRVANELNARRRSFTAADSKDEEVKVAPRRSFLDFDPHHFWQWSSFSDYVQCVLAFTGVAGYITYLSIDSALFVETLGFLAVLTEAMLGVPQLYRNHRHQSTEGMSIKMVLMWTSGDAFKTAYFLLKGAPLQFSVCGLLQVLVDLAILGQAYAFARHP

SEQ ID NO: 2937 - protein, 218 aa, Homo sapiens
MASLQRNGSHLCGGVLVHPKWVLTAAHCLAQRMAQLRLVLGLHTLDSPGLTFHIKAAIQHPRYKPVPALENDLALLQLDGKVKPSRTIRPLALPSKRQVVAAGTRCSMAGWGLTHQGGRLSRVLRELDLQVLDTRMCNNSRFWNGSLSPSMVCLAADSKDQAPCKGDSGGPLVCGKGRVLAGVLSFSSRVCTDIFKPPVATAVAPYVSWIRKVTGRSA

SEQ ID NO: 2938 - protein, 255 aa, Homo sapiens
MKLQAVMETLLQRQQRARQELEARQQLPPDPPAAPPGRARAAPDEDREPESARMQRAQMAALAAMRAAAAGLGHPASPGGSEDGPPGSEEEDAAREGTPGSPGRGREGPGEEHFEDMASDEDMKPKWEEEEMEEDLGEDEEEEEEDYEDEEEEEDEEGLGPPGPASLGTTALFPRKAQPPQAFRGDGVPRVLGGQERPGPGPAHPGGAAHVAPQLQPPDHGDWTYEEQFKQLYELDGDPKRKEFLDDLFSFMQKR

SEQ ID NO: 2939 - protein, 172 aa, Homo sapiens
MASDEGKLFVGGLSFDTNEQSLEQVFSKYGQISEVVVVKDRETQRSRGFGFVTFENIDDAKDAMMAMNGKSVDGRQIRVDQAGKSSDNRSRGYRGGSAGGRGFFRGGRGRGRGFSRGGGDRGYGGNRFESRSGGYGGSRDYYSSRSQSGGYSDRSSGGSYRDSYDSYATHNE

SEQ ID NO: 2940 - protein, 255 aa, Homo sapiens
MNNSGADEIGKLFVGGLDWSTTQETLRSYFSQYGEVVDCVIMKDKTTNQSRGFGFVKFKDPNCVGTVLASRPHTLDGRNIDPKPCTPRGMQPERTRPKEGWQKGPRSDNSKSNKIFVGGIPHNCGETELREYFKKFGVVTEVVMIYDAEKQRPRGFGFITFEDEQSVDQAVNMHFHDIMGKKVEVKRAEPRDSKSQAPGQPGASQWGSRVVPNAANGWAGQPPPTWQQGYGPQGMWVPAGQAIGGYGPPPAGRGA

SEQ ID NO: 2941 - protein, 255 aa, Homo sapiens
MAAAVAAALARLLAAFLLLAAQVACEYGMVHVVSQAGGPEGKDYCILYNPQWAHLPHDLSKASFLQLRNWTASLLCSAADLPARGFSNQIPLVARGNCTFYEKVRLAQGSGARGLLIVSRERLVPPGGNKTQYDEIGIPVALLSYKDMLDIFTRFGRTVRAALYAPKEPVLDYNMVIIFIMAVGTVAIGGYWAGSRDVKKRYMKHKRDDGPEKQEDEAVDVTPVMTCVFVVMCCSMLVLLYYFYDLLVYVVIGIF

SEQ ID NO: 2942 - protein, 255 aa, Homo sapiens
MYSSPLCLTQDEFHPFIEALLPHVRAFAYTWFNLQARKRKYFKKHEKRMSKDEERAVKDELLGEKPEVKQKWASRLLAKLRKDIRPECREDFVLSITGKKAPGCVLSNPDQKGKMRRIDCLRQADKVWRLDLVMVILFKGIPLESTDGERLVKAAQCGHPVLCVQPHHIGVAVKELDLYLAYFVRERDAEQSGSPRTGMGSDQEDSKPITLDTTDFQESFVTSGVFSVTELIQVSRTPVVTGTGPNFSLGELQGH

SEQ ID NO: 2943 - protein, 255 aa, Homo sapiens
MELWRQCTHWLIQCRVLPPSHRVTWDGAQVCELAQALRDGVLLCQLLNNLLPHAINLREVNLRPQMSQFLCLKNIRTFLSTCCEKFGLKRSELFEAFDLFDVQDFGKVIYTLSALSWTPIAQNRGIMPFPTEEESVGDEDIYSGLSDQIDDTVEEDEDLYDCVENEEAEGDEIYEDLMRSEPVSMPPKMTEYDKRCCCLREIQQTEEKYTDTLGSIQQHFLKPLQRFLKPQDIEIIFINIEDLLRVHTHFLKEMK

SEQ ID NO: 2944 - protein, 255 aa, Homo sapiens
MTVSQKGGPQPTPSPAGPGTQLGPITGEMDEADSAFLKFKQTADDSLSLTSPNTESIFVEDPYTASLRSEIESDGHEFEAESWSLAVDAAYAKKQKREVVKRQDVLYELMQTEVHHVRTLKIMLKVYSRALQEELQFSSKAIGRLFPCADDLLETHSHFLARLKERRQESLEEGSDRNYVIQKIGDLLVQQFSGENGERMKEKYGVFCSGHNEAVSHYKLLLQQNKKFQNLIKKIGNFSIVRRLGVQECILLVTQ

SEQ ID NO: 2945 - protein, 255 aa, Homo sapiens
MAPSGLKAVVGEKILSGVIRSVKKDGEWKVLIMDHPSMRILSSCCKMSDILAEGITIVEDINKRREPIPSLEAIYLLSPTEKSVQALIKDFQGTPTFTYKAAHIFFTDTCPEPLFSELGRSRLAKVVKTLKEIHLAFLPYEAQVFSLDAPHSTYNLYCPFRAEERTRQLEVLAQQIATLCATLQEYPAIRYRKGPEDTAQLAHAVLAKLNAFKADTPSLGEGPEKTRSQLLIMDRAADPVSPLLHELTFQAMAYD

SEQ ID NO: 2946 - protein, 187 aa, Homo sapiens
MEVEEIYKHQEVKMQAPAFRDKKQGVSAKNQGAHDPDYENITLAFKNQDHAKGGHSRPTSQVPAQCRPPSDSTQVPCWLYRAILSLYILLALAFVLCIILSAFIMVKNAEMSKELLGFKRELWNVSNSVQACEERQKRGWDSVQQSITMVRSKIDRLETTLAGIKNIDTKVQKILEVLQKMPQSSPQ

SEQ ID NO: 2947 - protein, 255 aa, Homo sapiens
MAALSPTFATSTQDSTCLQDSEFPVSSKDHSCPQNLDLFVCSGLEPHTPSVGSQESVTFQDVAVDFTEKEWPLLDSSQRKLYKDVMLENYSNLTSLGYQVGKPSLISHLEQEEEPRTEERGAHQGACADWETPSKTKWSLLMEDIFGKETPSGVTMERAGLGEKSTEYAHLFEVFGMDPHLTQPMGRHAGKRPYHRRDYGVAFKGRPHLTQHMSMYDGRKMHECHQCQKAFTTSASLTRHRRIHTGEKPYECSDC

SEQ ID NO: 2948 - protein, 255 aa, Homo sapiens
MRPMRIFVNDDRHVMAKHSSVYPTQEELEAVQNMVSHTERALKAVSDWIDEQEKGSSEQAESDNMDVPPEDDSKEGAGEQKTEHMTRTLRGVMRVGLVAKGLLLKGDLDLELVLLCKEKPTTALLDKVADNLAIQLAAVTEDKYEILQSVDDAAIVIKNTKEPPLSLTIHLTSPVVREEMEKVLAGETLSVNDPPDVLDRQKCLAALASLRHAKWFQARANGLKSCVIVIRVLRDLCTRVPTWGPLRGWPLELLC

SEQ ID NO: 2949 - protein, 255 aa, Homo sapiens
MSTPDPPLGGTPRPGPSPGPGPSPGAMLGPSPGPSPGSAHSMMGPSPGPPSAGHPIPTQGPGGYPQDNMHQMHKPMESMHEKGMSDDPRYNQMKGMGMRSGGHAGMGPPPSPMDQHSQGYPSPLGGSEHASSPVPASGPSSGPQMSSGPGGAPLDGADPQALGQQNRGPTPFNQNQLHQLRAQIMAYKMLARGQPLPDHLQMAVQGKRPMPGMQQQMPTLPPPSVSATGPGPGPGPGPGPGPGPAPPNYSRPHGM

SEQ ID NO: 2950 - protein, 255 aa, Homo sapiens
MLLPLLLLLPMCWAVEVKRPRGVSLTNHHFYDESKPFTCLDGSATIPFDQVNDDYCDCKDGSDEPGTAACPNGSFHCTNTGYKPLYIPSNRVNDGVCDCCDGTDEYNSGVICENTCKEKGRKERESLQQMAEVTREGFRLKKILIEDWKKAREEKQKKLIELQAGKKSLEDQVEMLRTVKEEAEKPEREAKEQHQKLWEEQLAAAKAQQEQELAADAFKELDDDMDGTVSVTELQTHPELDTDGDGALSEAEAQA

SEQ ID NO: 2951 - protein, 223 aa, Homo sapiens
MEVQKEAQRIMTLSVWKMYHSRMQRGGLRLHRSLQLSLVMRSARELYLSAKVEALEPEVSLPAALPSDPRLHPPREAESTAETATPDGEHPFPEPMDTQEAPTAEETSACCAPRPAKVSRKRRSSSLSDGGDAGLVPSKKARLEEKEEEEGASSEVADRLQPPPAQAEGAFPNLARVLQRRFSGLLNCSPAAPPTAPPACEAKPACRPADSMLNVLVRAVVAF

SEQ ID NO: 2952 - protein, 255 aa, Homo sapiens
MGERKGVNKYYPPDFNPEKHGSLNRYHNSHPLRERARKLSQGILIIRFEMPYNIWCDGCKNHIGMGVRYNAEKKKVGNYYTTPIYRFRMKCHLCVNYIEMQTDPANCDYVIVSGAQRKEERWDMADNEQVLTTEHEKKQKLETDAMFRLEHGEADRSTLKKALPTLSHIQEAQSAWKDDFALNSMLRRRFREKKKAIQEEEERDQALQAKASLTIPLVPETEDDRKLAALLKFHTLDSYEDKQKLKRTEIISRSW

SEQ ID NO: 2953 - protein, 255 aa, Homo sapiens
MAPSSKSERNSGAGSGGGGPGGAGGKRAAGRRREHVLKQLERVKISGQLSPRLFRKLPPRVCVSLKNIVDEDFLYAGHIFLGFSKCGRYVLSYTSSSGDDDFSFYIYHLYWWEFNVHSKLKLVRQVRLFQDEEIYSDLYLTVCEWPSDASKVIVFGFNTRSANGMLMNMMMMSDENHRDIYVSTVAVPPPGRCAACQDASRAHPGDPNAQCLRHGFMLHTKYQVVYPFPTFQPAFQLKKDQVVLLNTSYSLVACA

SEQ ID NO: 2954 - protein, 255 aa, Homo sapiens
MRGGRGAPFWLWPLPKLALLPLLWVLFQRTRPQGSAGPLQCYGVGPLGDLNCSWEPLGDLGAPSELHLQSQKYRSNKTQTVAVAAGRSWVAIPREQLTMSDKLLVWGTKAGQPLWPPVFVNLETQMKPNAPRLGPDVDFSEDDPLEATVHWAPPTWPSHKVLICQFHYRRCQEAAWTLLEPELKTIPLTPVEIQDLELATGYKVYGRCRMEKEEDLWGEWSPILSFQTPPSAPKDVWVSGNLCGTPGGEEPLLLW

SEQ ID NO: 2955 - protein, 255 aa, Homo sapiens
MALSEPILPSFSTFASPCRERGLQERWPRAEPESGGTDDDLNSVLDFILSMGLDGLGAEAAPEPPPPPPPPAFYYPEPGAPPPYSAPAGGLVSELLRPELDAPLGPALHGRFLLAPPGRLVKAEPPEADGGGGYGCAPGLTRGPRGLKREGAPGPAASCMRGPGGRPPPPPDTPPLSPDGPARLPAPGPRASFPPPFGGPGFGAPGPGLHYAPPAPPAFGLFDDAAAAAAALGLAPPAARGLLTPPASPLELLEA

SEQ ID NO: 2956 - protein, 255 aa, Homo sapiens
MAHAGGGSGGSGAGGPAGRGLSGARWGRSGSAGHEKLPVHVEDALTYLDQVKIRFGSDPATYNGFLEIMKEFKSQSIDTPGVIRRVSQLFHEHPDLIVGFNAFLPLGYRIDIPKNGKLNIQSPLTSQENSHNHGDGAEDFKQQVPYKEDKPQVPLESDSVEFNNAISYVNKIKTRFLDHPEIYRSFLEILHTYQKEQLNTRGRPFRGMSEEEVFTEVANLFRGQEDLLSEFGQFLPEAKRSLFTGNGPCEMHSVQ

SEQ ID NO: 2957 - protein, 102 aa, Homo sapiens
MADFLKGLPVYNKSNFSRFHADSVCKASNRRPSVYLPTREYPSEQIIVTEKTNILLRYLHQQWDKKNAAKKRDQEQVELEGESSAPPRKVARTDSPDMHEDT

SEQ ID NO: 2958 - protein, 255 aa, Homo sapiens
MWRGLWTLAAQAARGPRRLCTRRSSGAPAPGSGATIFALSSGQGRCGIAVIRTSGPASGHALRILTAPRDLPLARHASLRLLSDPRSGEPLDRALVLWFPGPQSFTGEDCVEFHVHGGPAVVSGVLQALGSVPGLRPAEAGEFTRRAFANGKLNLTEVEGLADLIHAETEAQRRQALRQLDGELGHLCRGWAETLTKALAHVEAYIDFGEDDNLEEGVLEQGGSTWWWGRKTPHISPQRLPSLSLSACLLSPTAD

SEQ ID NO: 2959 - protein, 255 aa, Homo sapiens
MGPDRKEVPLSRGTQAVVVGKGRGAPGDDSSMGGRPSSPLDKQQRQHLRGQVDTLLRNFLPCYRGQLAASVLRQISRELGPQEPTGSQLLRSKKLPRVREHRGPLTQLRGHPPRWQPIFCVLRGDGRLEWFSHKEEYENGGHCLGSTALTGYTLLTSQREYLRLLDALCPESLGDHTQEEPDSLLEVPVSFPLFLQHPFRRHLCFSAATREAQHAWRLALQGGIRLQGTVLQRSQAPAARAFLDAVRLYRQHQGH

SEQ ID NO: 2960 - protein, 255 aa, Homo sapiens
MSYFGEHFWGEKNHGFEVLYHSVKQGPISTKELADFIRERATIEETYSKAMAKLSKLASNGTPMGTFAPLWEVFRVSSDKLALCHLELTRKLQDLIKDVLRYGEEQLKTHKKCKEEVVSTLDAVQVLSGVSQLLPKSRENYLNRCMDQERLRRESTSQKEMDKAETKTKKAAESLRRSVEKYNSARADFEQKMLDSALRFQAMEETHLRHMKALLGSYAHSVEDTHVQIGQVHEEFKQNIENVSVEMLLRKFAES

SEQ ID NO: 2961 - protein, 255 aa, Homo sapiens
MLFDKVKAFSVQLDGATAGVEPVFSGGQAVAGRVLLELSSAARVGALRLRARGRAHVHWTESRSAGSSTAYTQSYSERVEVVSHRATLLAPDTGETTTLPPGRHEFLFSFQLPPTLVTSFEGKHGSVRYCIKATLHRPWVPARRARKVFTVIEPVDINTPALLAPQAGAREKVARSWYCNRGLVSLSAKIDRKGYTPGEVIPVFAEIDNGSTRPVLPRAAVVQTQTFMARGARKQKRAVVASLAGEPVGPGQRAL

SEQ ID NO: 2962 - protein, 250 aa, Homo sapiens
MTLSPLLLFLPPLLLLLDVPTAAVQASPLQALDFFGNGPPVNYKTGNLYLRGPLKKSNAPLVNVTLYYEALCGGCRAFLIRELFPTWLLVMEILNVTLVPYGNAQEQNVSGRWEFKCQHGEEECKFNKVEACVLDELDMELAFLTIVCMEEFEDMERSLPLCLQLYAPGLSPDTIMECAMGDRGMQLMHANAQRTDALQPPHEYVPWVTVNGKPLEDQTQLLTLVCQLYQGKKPDVCPSSTSSLRSVCFK

SEQ ID NO: 2963 - protein, 179 aa, Homo sapiens
MITETAAEPTVPAVPAAEEATEARGREEPAWPWKDAPIRTLVQRIHQLQAERAQGFRRLEEGHRQYLRSGPDYDFARYRSTVHGVTQAFAAASREVLAVEAELGGPRRQPLLAGHVRSLQELEQTRLGTVALLQLMETPELAGQEDAVRMQQLKMKVIKTMEAISEVLQDLRFDAESAE

SEQ ID NO: 2964 - protein, 255 aa, Homo sapiens
MATSNNPRKFSEKIALHNQKQAEETAAFEEVMKDLSLTRAARLQLQKSQYLQLGPSRGQYYGGSLPNVNQIGSGTMDLPFQPSGFLGEALAAAPVSLTPFQSSGLDTSRTTRHHGLVDRVYRERGRLGSPHRRPLSVDKHGRQADSCPYGTMYLSPPADTSWRRTNSDSALHQSTMTPTQPESFSSGSQDVHQKRVLLLTVPGMEETTSEADKNLSKQAWDTKKTGSRPKSCEVPGINIFPSADQENTTALIPAT

SEQ ID NO: 2965 - protein, 255 aa, Homo sapiens
MELTQPAEDLIQTQQTPASELGDPEDPGEEAADGSDTVVLSLFPCTPEPVNPEPDASVSSPQAGSSLKHSTTLTNRQRGNEVSALPATLDSLSIHQLAAQGELDQLKEHLRKGDNLVNKPDERGFTPLIWASAFGEIETVRFLLEWGADPHILAKERESALSLASTGGYTDIVGLLLERDVDINIYDWNGGTPLLYAVRGNHVKCVEALLARGADLTTEADSGYTPMDLAVALGYRKVQQVIENHILKLFQSNLV

SEQ ID NO: 2966 - protein, 255 aa, Homo sapiens
MDSVAFEDVAVNFTQEEWALLSPSQKNLYRDVTLETFRNLASVGIQWKDQDIENLYQNLGIKLRSLVERLCGRKEGNEHRETFSQIPDCHLNKKSQTGVKPCKCSVCGKVFLRHSFLDRHMRAHAGHKRSECGGEWRETPRKQKQHGKASISPSSGARRTVTPTRKRPYECKVCGKAFNSPNLFQIHQRTHTGKRSYKCREIVRAFTVSSFFRKHGKMHTGEKRYECKYCGKPIDYPSLFQIHVRTHTGEKPYKC

SEQ ID NO: 2967 - protein, 137 aa, Homo sapiens
MDDLRYGVYPVKGASGYPGAERNLLEYSYFEKGPLTFRDVVIEFSQEEWQCLDTAQQDLYRKVMLENFRNLVFLGIDVSKPDLITCLEQGKDPWNMKRHSMVATPPESGVLKFPTIIILLSRCFFQSVNICFIYLEP

SEQ ID NO: 2968 - protein, 255 aa, Homo sapiens
MGSLTFWDVTIEFALEEWQCLDMAQQNLYRNVMLENYRNLVFLGIAVSKLDLITCLKQGKEPWNMKRHEMVTKPPVISSHFTQDFWPDQSIKDSFQEIILRTYARCGHKNLRLRKDCESVNEGKMHEEAYNKLNQCWTTTQGKIFQCNKYVKVFHKYSNSNRYKIRHTKKKTFKCMKCSKSFFMLSHLIQHKRIHTRENIYKCEERGKAFKWFSTLIKHKIIHTEDKPYKYKKCGKAFNISSMFTKCKIIHTGKK

SEQ ID NO: 2969 - protein, 255 aa, Homo sapiens
MTTWSSLQGSHVSKRALAYALVVTNCQERIQHWKKVDNDYNALRERLSTLPDKLSYNIMVPFGPFAFMPGKLVHTNEVTVLLGDNWFAKCSAKQAVGLVEHRKEHVRKTIDDLKKVMKNFESRVEFTEDLQKMSDAAGDIVDIREEIKCDFEFKAKHRIAHKPHSKPKTSDIFEADIANDVKSKDLLADKELWARLEELERQEELLGELDSKPDTVIANGEDTTSSEEEKEDRNTNVNAMHQVTDSHTPCHKDVA

SEQ ID NO: 2970 - protein, 255 aa, Homo sapiens
MYCCSAQDSKMDYKRRFLLGGSKQKVQQHQQYPMPELGRALSAPLASTATTAPLGSLTAAGSCHHAMPHTTPIADIQQGISKYLDALNVFCRASTFLTDLFSTVFRNSHYSKAATQLKDVQEHVMEAASRLTSAIKPEIAKMLMELSAGAANFTDQKEFSLQDIEVLGRCFLTVVQVHFQFLTHALQKVQPVAHSCFAEVIVPEKKNSGSGGGLSGMGHTPEVEEAVRSWRGAAEATSRLRERGCDGCLAGIEVQ

SEQ ID NO: 2971 - protein, 255 aa, Homo sapiens
MDMLDPGLDPAASATAAAAASHDKGPEAEEGVELQEGGDGPGAEEQTAVAITSVQQAAFGDHNIQYQFRTETNGGQVTYRVVQVTDGQLDGQGDTAGAVSVVSTAAFAGGQQAVTQVGVDGAAQRPGPAAASVPPGPAAPFPLAVIQNPFSNGGSPAAEAVSGEARFAYFPASSVGDTTAVSVQTTDQSLQAGGQFYVMMTPQDVLQTGTQRTIAPRTHPYSPKIDGTRTPRDERRRAQHNEVERRRRDKINNWI

SEQ ID NO: 2972 - protein, 175 aa, Homo sapiens
MLFLATFFPTWEGGIYDFIGEFMKASVDVADLIGLNLVMSRNAGKGEYKIMVAALGWATAELIMSRCIPLWVGARGIEFDWKYIQMSIDSNISLVHYIVASAQVWMITRYDLYHTFRPAVLLLMFLSVYKAFVMETFVHLCSLGSWAALLARAVVTGLLALSTLALYVAVVNVHS

SEQ ID NO: 2973 - protein, 101 aa, Homo sapiens
MNLERVSNEEKLNLCRKYYLGGFAFLPFLWLVNIFWFFREAFLVPAYTEQSQIKGYVWRSAVGFLFWVIVLTSWITIFQIYRPRWGALGDYLSFTIPLGTP

SEQ ID NO: 2974 - protein, 255 aa, Homo sapiens
MDRSLPVFSIQDSPFGDAPLGRSHYWPSQSQTWCPKTLSPSRSQRSRLPQAPKALATGPNSPELFEESWPSSSGTPSLPSTTEGQMWASPAPTLIDSGDSVVAKYINRFRQAQPTSREERQPAGPTPADFWWLQSDSPDPSSQSAAAGANKPEGRPHTAVPTAVNVTSASHAVAPLQEIKQNLHTWNSSLLDLETLSLQSRAARLLKRSKASISSSSSLSPSDASTSSFPTSSDGLSPFSETFIPDSSKGLGPRA

SEQ ID NO: 2975 - protein, 244 aa, Homo sapiens
MEVTGVSAPTVTVFISSSLNTFRSEKRYSRSLTIAEFKCKLELLVGSPASCMELELYGVDDKFYSKLDQEDALLGSYPVDDGCRIHVIDHSGARLGEYEDVSRVEKYTISQEAYDQRQDTVRSFLKRSKLGRYNEEERAQQEAEAAQRLAEEKAQASSIPVGSRCEVRAAGQSPRRGTVMYVGLTDFKPGYWIGVRYDEPLGKNDGSVNGKRYFECQAKYGAFVKPAVVTVGDFPEEDYGLDEI

SEQ ID NO: 2976 - protein, 255 aa, Homo sapiens
MPLQGSVSFKDVTVDFTQEEWQQLDPAQKALYRDVMLENYCHFVSVGFHMAKPDMIRKLEQGEELWTQRIFPSYSYLEEDGKTEDVLVKFKEYQDRHSRPLIFINHKKLIKERSNIYGKTFTLGKNRISKTILCEYKPDGKVLKNISELVIRNISPIKEKFGDSTGWEKSLLNTKHEKIHPAVNLHKQTERVLSGKQELIQHQKVQAPEQPFDHNECEKSFLMKGMLFTHTRAHRGERTFEYNKDGIAFIEKSSL

SEQ ID NO: 2977 - protein, 255 aa, Homo sapiens
MTSQSSVISNSCVTMERLSHMMERKAWCSQESALSEEEEDTTRPLETVTFKDVAVDLTQEEWEQMKPAQRNLYRDVMLENYSNLVTVGCQVTKPDVIFKLEQEEEPWVMEEEMFGRHCPEVWEVDEQIKKQQETLVRKVTSISKKILIKEKVIECKKVAKIFPLSSDIVTSRQSFYDCDSLDKGLEHNLDLLRYEKGCVREKQSNEFGKPFYHCASYVVTPFKCNQCGQDFSHKFDLIRHERIHAGEKPYECKEC

SEQ ID NO: 2978 - protein, 255 aa, Homo sapiens
MARKLVMFRDVAIDFSQEEWECLDSAQRDLYRDVMLENYSNLVSLDLPSRCASKDLSPEKNTYETELSQWEMSDRLENCDLEESNSRDYLEAKGKMEKQQENQKEYFRQGMIIYDKMSIFNQHTYLSQHSRCHSTEKPYKCKECGKAFRRASHLTQHQSIHTGEKPYECKQCGKAFSRDSQLSLHQRLHTGEKPYACKECGKAFTQSSQLILHHRIHTGEKPYKCEECGKAFIRSSQLTRHQKVHTGEKPYECKE

SEQ ID NO: 2979 - protein, 255 aa, Homo sapiens
MAEGSVMFSDVSIDFSQEEWDCLDPVQRDLYRDVMLENYGNLVSMGLYTPKPQVISLLEQGKEPWMVGRELTRGLCSDLESMCETKLLSLKKEVYEIELCQREIMGLTKHGLEYSSFGDVLEYRSHLAKQLGYPNGHFSQEIFTPEYMPTFIQQTFLTLHQIINNEDRPYECKKCGKAFSQNSQFIQHQRIHIGEKSYECKECGKFFSCGSHVTRHLKIHTGEKPFECKECGKAFSCSSYLSQHQRIHTGKKPYE

SEQ ID NO: 2980 - protein, 255 aa, Homo sapiens
MEAVATATAAKEPDKGCIEPGPGHWGELSRTPVPSKPQDKVEAAEATPVALDSDTSGAENAAVSAMLHAVAASRLPVCSQQQGEPDLTEHEKVAILAQLYHEKPLVFLERFRTGLREEHLACFGHVRGDHRADFYCAEVARQGTARPRTLRTRLRNRRYAALRELIQGGEYFSDEQMRFRAPLLYEQYIGQYLTQEELSARTPTHQPPKPGSPGRPACPLSNLLLQSYEERELQQRLLQQQEEEEACLEEEEEEE

SEQ ID NO: 2981 - protein, 255 aa, Homo sapiens
MTEESEETVLYIEHRYVCSECNQLYGSLEEVLMHQNSHVPQQHFELVGVADPGVTVATDTASGTGLYQTLVQESQYQCLECGQLLMSPSQLLEHQELHLKMMAPQEAVPAEPSPKAPPLSSSTIHYECVDCKALFASQELWLNHRQTHLRATPTKAPAPVVLGSPVVLGPPVGQARVAVEHSYRKAEEGGEGATVPSAAATTTEVVTEVELLLYKCSECSQLFQLPADFLEHQATHFPAPVPESQEPALQQEVQA

SEQ ID NO: 2982 - protein, 255 aa, Homo sapiens
MSAVLLLALLGFILPLPGVQALLCQFGTVQHVWKVSDLPRQWTPKNTSCDSGLGCQDTLMLIESGPQVSLVLSKGCTEAKDQEPRVTEHRMGPGLSLISYTFVCRQEDFCNNLVNSLPLWAPQPPADPGSLRCPVCLSMEGCLEGTTEEICPKGTTHCYDGLLRLRGGGIFSNLRVQGCMPQPVCNLLNGTQEIGPVGMTENCDMKDFLTCHRGTTIMTHGNLAQEPTDWTTSNTEMCEVGQVCQETLLLLDVGL

SEQ ID NO: 2983 - protein, 255 aa, Homo sapiens
MTTFKEAVTFKDVAVFFTEEELGLLDPAQRKLYQDVMLENFTNLLSVGHQPFHPFHFLREEKFWMMETATQREGNSGGKTIAEAGPHEDCPCQQIWEQTASDLTQSQDSIINNSHFFEQGDVPSQVEAGLSIIHTGQKPSQNGKCKQSFSDVAIFDPPQQFHSGEKSHTCNECGKSFCYISALRIHQRVHLREKLSKCDMRGKEFSQSSCLQTRERVHTGEKPFKCEQCGKGFRCRAILQVHCKLHTGEKPYICE

SEQ ID NO: 2984 - protein, 255 aa, Homo sapiens
MSETVICSSRATVMLYDDGNKRWLPAGTGPQAFSRVQIYHNPTANSFRVVGRKMQPDQQVVINCAIVRGVKYNQATPNFHQWRDARQVWGLNFGSKEDAAQFAAGMASALEALEGGGPPPPPALPTWSVPNGPSPEEVEQQKRQQPGPSEHIERRVSNAGGPPAPPAGGPPPPPGPPPPPGPPPPPGLPPSGVPAAAHGAGGGPPPAPPLPAAQGPGGGGAGAPGLAAAIAGAKLRKVSKQEEASGGPTAPKAES

SEQ ID NO: 2985 - protein, 255 aa, Homo sapiens
MAARKGRRRTCETGEPMEAESGDTSSEGPAQVYLPGRGPPLREGEELVMDEEAYVLYHRAQTGAPCLSFDIVRDHLGDNRTELPLTLYLCAGTQAESAQSNRLMMLRMHNLHGTKPPPSEGSDEEEEEEDEEDEEERKPQLELAMVPHYGGINRVRVSWLGEEPVAGVWSEKGQVEVFALRRLLQVVEEPQALAAFLRDEQAQMKPIFSFAGHMGEGFALDWSPRVTGRLLTGDCQKNIHLWTPTDGGSWHVDQR

SEQ ID NO: 2986 - protein, 235 aa, Homo sapiens
MTVLAPAWSPTTYLLLLLLLSSGLSGTQDCSFQHSPISSDFAVKIRELSDYLLQDYPVTVASNLQDEELCGGLWRLVLAQRWMERLKTVAGSKMQGLLERVNTEIHFVTKCAFQPPPSCLRFVQTNISRLLQETSEQLVALKPWITRQNFSRCLELQCQPDSSTLPPPWSPRPLEATAPTAPQPPLLLLLLLPVGLLLLAAAWCLHWQRTRRRTPRPGEQVPPVPSPQDLLLVEH

SEQ ID NO: 2987 - protein, 255 aa, Homo sapiens
MPADVNLSQKPQVLGPEKQDGSCEASVSFEDVTVDFSREEWQQLDPAQRCLYRDVMLELYSHLFAVGYHIPNPEVIFRMLKEKEPRVEEAEVSHQRCQEREFGLEIPQKEISKKASFQKDMVGEFTRDGSWCSILEELRLDADRTKKDEQNQIQPMSHSAFFNKKTLNTESNCEYKDPGKMIRTRPHLASSQKQPQKCCLFTESLKLNLEVNGQNESNDTEQLDDVVGSGQLFSHSSSDACSKNIHTGETFCKGN

SEQ ID NO: 2988 - protein, 255 aa, Homo sapiens
MLREEAAQKRKGKEPGMALPQGRLTFRDVAIEFSLAEWKCLNPSQRALYREVMLENYRNLEAVDISSKCMMKEVLSTGQGNTEVIHTGTLQRHESHHIGDFCFQEIEKEIHDIEFQCQEDERNGLEAPMTKIKKLTGSTDQHDHRHAGNKPIKDQLGSSFYSHLPELHIFQIKGEIGNQLEKSTNDAPSVSTFQRISCRPQTQISNNYGNNPLNSSLLPQKQEVHMREKSFQCNKSGKAFNCSSLLRKHQIPHLG

SEQ ID NO: 2989 - protein, 255 aa, Homo sapiens
MAANVGDQRSTDWSSQYSMVAGAGRENGMETPMHENPEWEKARQALASISKSGAAGGSAKSSSNGPVASAQYVSQAEASALQQQQYYQWYQQYNYAYPYSYYYPMSMYQSYGSPSQYGMAGSYGSATPQQPSAPQHQGTLNQPPVPGMDESMSYQAPPQQLPSAQPPQPSNPPHGAHTLNSGPQPGTAPATQHSQAGPATGQAYGPHTYTEPAKPKKGQQLWNRMKPAPGTGGLKFNIQKRPFAVTTQSFGSNAE

SEQ ID NO: 2990 - protein, 255 aa, Homo sapiens
MDPKQTTLLCLVLCLGQRIQAQEGDFPMPFISAKSSPVIPLDGSVKIQCQAIREAYLTQLMIIKNSTYREIGRRLKFWNETDPEFVIDHMDANKAGRYQCQYRIGHYRFRYSDTLELVVTGLYGKPFLSADRGLVLMPGENISLTCSSAHIPFDRFSLAKEGELSLPQHQSGEHPANFSLGPVDLNVSGIYRCYGWYNRSPYLWSFPSNALELVVTDSIHQDYTTQNLIRMAVAGLVLVALLAILVENWHSHTAL

SEQ ID NO: 2991 - protein, 169 aa, Homo sapiens
MSAHLQWMVVRNCSSFLIKRNKQTYSTEPNNLKARNSFRYNGLIHRKTVGVEPAADGKGVVVVIKRRSGQRKPATSYVRTTINKNARATLSSIRHMIRKNKYRPDLRMDMLASTGSGLCCSVAVQPWASSSTSLCLRTLICNMRVDRPYYSGLMRRLNVQNLLDCAHKS

SEQ ID NO: 2992 - protein, 255 aa, Homo sapiens
MSDFDEFERQLNENKQERDKENRHRKRSHSRSRSRDRKRRSRSRDRRNRDQRSASRDRRRRSKPLTRGAKEEHGGLIRSPRHEKKKKVRKYWDVPPPGFEHITPMQYKAMQAAGQIPATALLPTMTPDGLAVTPTPVPVVGSQMTRQARRLYVGNIPFGITEEAMMDFFNAQMRLGGLTQAPGNPVLAVQINQDKNFAFLEFRSVDETTQAMAFDGIIFQGQSLKIRRPHDYQPLPGMSENPSVYVPGVVSTVVP

SEQ ID NO: 2993 - protein, 255 aa, Homo sapiens
MRGAASASVREPTPLPGRGAPRTKPRAGRGPTVGTPATLALPARGRPRSRNGLASKGQRGAAPTGPGHRALPSRDTALPQERNKKLEAVGTGIEPKAMSQGLVTFGDVAVDFSQEEWEWLNPIQRNLYRKVMLENYRNLASLGLCVSKPDVISSLEQGKEPWTVKRKMTRAWCPDLKAVWKIKELPLKKDFCEGKLSQAVITERLTSYNLEYSLLGEHWDYDALFETQPGLVTIKNLAVDFRQQLHPAQKNFCKN

SEQ ID NO: 2994 - protein, 255 aa, Homo sapiens
MAAAWMAPAQESVTFEDVAVTFTQEEWGQLDVTQRALYVEVMLETCGLLVALGDSTKPETVEPIPSHLALPEEVSLQEQLAQGVPRYSYLGQAMDQDGPSEMQEYFLRPGTDPQSEKLHGKMSLEHEGLATADGICSMMIQNQVSPEDALYGFDSYGPVTDSLIHEGENSYKFEEMFNENCFLVQHEQILPRVKPYDCPECGKAFGKSKHLLQHHIIHTGEKPYKCLECGKDFNRRSHLTRHQRTHNGDKPFVCS

SEQ ID NO: 2995 - protein, 255 aa, Homo sapiens
MAEAALVNTPQGHVTFEDIAVYFSQEEWGLLDEAQRCLYHDVMLENFSLMASVGCLHGIEAEEAPSEQTLSAQGVSQARTPKLGPSIPNAHSCEMCILVMKDILYLSEHQGTLPWQKPYTSVASGKWFSFGSNLQQHQNQDSGEKHIRKEESSALLLNSCKIPLSDNLFPCKDVEKDFPTILGLLQHQTTHSRQEYAHRSRETFQQRRYKCEQVFNEKVHVTEHQRVHTGEKAYKRREYGKSLNSKYLFVEHQRT

SEQ ID NO: 2996 - protein, 576 aa, Homo sapiens
MRTLRQREVEYFSKATQLVRGSTKDRGAQVPIATEVLFKLTQGSVTFEDVAVYFSWEEWDLLDEAQKHLYFDVMLENFALTSSLGCWCGVEHEETPSEQRISGERVPQFRTSKEGSSSQNADSCEICCLVLRDILHLAEHQGTNCGQKLHTCGKQFYISANLQQHQRQHITEAPFRSYVDTASFTQSCIVHVSEKPFTCREIRKDFLANMRFLHQDATQTGEKPNNSNKCAVAFYSGKSHHNWGKCSKAFSHIDTLVQDQRILTREGLFECSKCGKACTRRCNLIQHQKVHSEERPYECNECGKFFTYYSSFIIHQRVHTGERPYACPECGKSFSQIYSLNSHRKVHTGERPYECGECGKSFSQRSNLMQHRRVHTGERPYECSECGKSFSQNFSLIYHQRVHTGERPHECNECGKSFSRSSSLIHHRRLHTGERPYECSKCGKSFKQSSSFSSHRKVHTGERPYVCGECGKSFSHSSNLKNHQRVHTGERPVECSECSKSFSCKSNLIKHLRVHTGERPYECSECGKSFSQSSSLIQHRRVHTGKRPYQCSQCGKSFGCKSVLIQHQRVHIGEKP

SEQ ID NO: 2997 - protein, 255 aa, Homo sapiens
MAAAVPRRPTQQGTVTFEDVAVNFSQEEWCLLSEAQRCLYRDVMLENLALISSLGCWCGSKDEEAPCKQRISVQRESQSRTPRAGVSPKKAHPCEMCGLILEDVFHFADHQETHHKQKLNRSGACGKNLDDTAYLHQHQKQHIGEKFYRKSVREASFVKKRKLRVSQEPFVFREFGKDVLPSSGLCQEEAAVEKTDSETMHGPPFQEGKTNYSCGKRTKAFSTKHSVIPHQKLFTRDGCYVCSDCGKSFSRYVSF

SEQ ID NO: 2998 - protein, 255 aa, Homo sapiens
MASRLPTAWSCEPVTFEDVTLGFTPEEWGLLDLKQKSLYREVMLENYRNLVSVEHQLSKPDVVSQLEEAEDFWPVERGIPQDTIPEYPELQLDPKLDPLPAESPLMNIEVVEVLTLNQEVAGPRNAQIQALYAEDGSLSADAPSEQVQQQGKHPGDPEAARQRFRQFRYKDMTGPREALDQLRELCHQWLQPKARSKEQILELLVLEQFLGALPVKLRTWVESQHPENCQEVVALVEGVTWMSEEEVLPAGQPAE

SEQ ID NO: 2999 - protein, 255 aa, Homo sapiens
MEARSMLVPPQASVCFEDVAMAFTQEEWEQLDLAQRTLYREVTLETWEHIVSLGLFLSKSDVISQLEQEEDLCRAEQEAPRDWKATLEENRLNSEKDRAREELSHHVEVYRSGPEEPPSLVLGKVQDQSNQLREHQENSLRFMVLTSERLFAQREHCELELGGGYSLPSTLSLLPTTLPTSTGFPKPNSQVKELKQNSAFINHEKNGADGKHCESHQCARAFCQSIYLSKLGNVETGKKNPYEYIVSGDSLNYGS

SEQ ID NO: 3000 - protein, 255 aa, Homo sapiens
MDPEDEGVAGVMSVGPPAARLQEPVTFRDVAVDFTQEEWGQLDPTQRILYRDVMLETFGHLLSIGPELPKPEVISQLEQGTELWVAERGTTQGCHPAWEPRSESQASRKEEGLPEEEPSHVTGREGFPTDAPYPTTLGKDRECQSQSLALKEQNNLKQLEFGLKEAPVQDQGYKTLRLRENCVLSSSPNPFPEISRGEYLYTYDSQITDSEHNSSLVSQQTGSPGKQPGENSDCHRDSSQAIPITELTKSQVQDK

SEQ ID NO: 3001 - protein, 255 aa, Homo sapiens
MAASAAAASAAAASAASGSPGPGEGSAGGEKRSTAPSAAASASASAAASSPAGGGAEALELLEHCGVCRERLRPEREPRLLPCLHSACSACLGPAAPAAANSSGDGGAAGDGTVVDCPVCKQQCFSKDIVENYFMRDSGSKAATDAQDANQCCTSCEDNAPATSYCVECSEPLCETCVEAHQRVKYTKDHTVRSTGPAKSRDGERTVYCNVHKHEPLVLFCESCDTLTCRDCQLNAHKDHQYQFLEDAVRNQRKL

SEQ ID NO: 3002 - protein, 255 aa, Homo sapiens
MEFVRALWLGLALALGPGSAGGHPQPCGVLARLGGSVRLGALLPRAPLARARARAALARAALAPRLPHNLSLELVVAAPPARDPASLTRGLCQALVPPGVAALLAFPEARPELLQLHFLAAATETPVLSLLRREARAPLGAPNPFHLQLHWASPLETLLDVLVAVLQAHAWEDVGLALCRTQDPGGLVALWTSRAGRPPQLVLDLSRRDTGDAGLRARLAPMAAPVGGEAPVPAAVLLGCDIARARRVLEAVPPG

SEQ ID NO: 3003 - protein, 242 aa, Homo sapiens
MGLAASGAKEKHPTNQGEEGSRPPHGRKLRSERQGWAGPVLGALQTPDQGRLSSPREGPVHGRSQPHRADCTGDAHEDSRPLRTQLSRHRSPSAKARVQIMQTEARLPWTPEPQTPSTKAKWTHLHQIHHKDGLPDSGGNGVSLCHPDWSAFSPHRVGAAGRHPAPVSLHSKAVTSVASSCLCDDPHEGCRVKGTAGFGLTPRGALGERAWSWGAAQVFYIPWPPSSPARLSSWPCAPGDAC

SEQ ID NO: 3004 - protein, 68 aa, Homo sapiens
MSATNNIAQARKLVEQLRIEAGIERIKVSKAASDLMSYCEQHARNDPLLVGVPASENPFKDKKPCIIL

SEQ ID NO: 3005 - protein, 255 aa, Homo sapiens
MCHKNGFPQEGGITAAFLQKRKLRLSKNHRPARAKVTEHVRGTRPGRATAGPAASTRAAGSLFFDRWGNRGPAGCRGSSHLPQQLKFTTSDSCDRIKDEFQLLQAQYHSLKLECDKLASEKSEMQRHYVMYYEMSYGLNIEMHKQAEIVKRLNGICAQVLPYLSQEHQQQVLGAIERAKQVTAPELNSIIRQQLQAHQLSQLQALALPLTPLPVGLQPPSLPAVSAGTGLLSLSALGSQAHLSKEDKNGHDGDTH

SEQ ID NO: 3006 - protein, 255 aa, Homo sapiens
MVNFTVDQIRAIMDKKANIRNMSVIAHVDHGKSTLTDSLVCKAGIIASARAGETRFTDTRKDEQERCITIKSTAISLFYELSENDLNFIKQSKDGAGFLINLIDSPGHVDFSSEVTAALRVTDGALVVVDCVSGVCVQTETVLRQAIAERIKPVLMMNKMDRALLELQLEPEELYQTFQRIVENVNVIISTYGEGESGPMGNIMIDPVLGTVGFGSGLHGWAFTLKQFAEMYVAKFAAKGEGQLGPAERAKKVED

SEQ ID NO: 3007 - protein, 255 aa, Homo sapiens
MSEEEAAQIPRSSVWEQDQQNVVQRVVALPLVRATCTAVCDVYSAAKDRHPLLGSACRLAENCVCGLTTRALDHAQPLLEHLQPQLATMNSLACRGLDKLEEKLPFLQQPSETVVTSAKDVVASSVTGVVDLARRGRRWSVELKRSVSHAVDVVLEKSEELVDHFLPMTEEELAALAAEAEGPEVGSVEDQRRQQGYFVRLGSLSARIRHLAYEHSVGKLRQSKHRAQDTLAQLQETLELIDHMQCGVTPTAPAC

SEQ ID NO: 3008 - protein, 255 aa, Homo sapiens
MSADGAEADGSTQVTVEEPVQQPSVVDRVASMPLISSTCDMVSAAYASTKESYPHIKTVCDAAEKGVRTLTAAAVSGAQPILSKLEPQIASASEYAHRGLDKLEENLPILQQPTEKVLADTKELVSSKVSGAQEMVSSAKDTVATQLSEAVDATRGAVQSGVDKTKSVVTGGVQSVMGSRLGQMVLSGVDTVLGKSEEWADNHLPLTDAELARIATSLDGFDVASVQQQRQEQSYFVRLGSLSERLRQHAYEHSL

SEQ ID NO: 3009 - protein, 255 aa, Homo sapiens
MAPTWGPGMVSVVGPMGLLVVLLVGGCAAEEPPRFIKEPKDQIGVSGGVASFVCQATGDPKPRVTWNKKGKKVNSQRFETIEFDESAGAVLRIQPLRTPRDENVYECVAQNSVGEITVHAKLTVLREDQLPSGFPNIDMGPQLKVVERTRTATMLCAASGNPDPEITWFKDFLPVDPSASNGRIKQLRSETFESTPIRGALQIESSEETDQGKYECVATNSAGVRYSSPANLYVRELREVRRVAPRFSILPMSHE

SEQ ID NO: 3010 - protein, 255 aa, Homo sapiens
MAETLPGSGDSGPGTASLGPGVAETGTRRLSELRVIDLRAELKKRNLDTGGNKSVLMERLKKAVKEEGQDPDEIGIELEATSKKSAKRCVKGLKMEEEGTEDNGLEDDSRDGQEDMEASLENLQNMGMMDMSVLDETEVANSSAPDFGEDGTDGLLDSFCDSKEYVAAQLRQLPAQPPEHAVDGEGFKNTLETSSLNFKVTPDIEESLLEPENEKILDILGETCKSEPVKEESSELEQPFAQDTSSVGPDRKLAE

SEQ ID NO: 3011 - protein, 255 aa, Homo sapiens
MADLANEEKPAIAPPVFVFQKDKGQKSPAEQKNLSDSGEEPRGEAEAPHHGTGHPESAGEHALEPPAPAGASASTPPPPAPEAQLPPFPRELAGRSAGGSSPEGGEDSDREDGNYCPPVKRERTSSLTQFPPSQSEERSSGFRLKPPTLIHGQAPSAGLPSQKPKEQQRSVLRPAVLQAPQPKALSQTVPSSGTNGVSLPADCTGAVPAASPDTAAWRSPSEAADEEKEPQKNESSNASEEEACEKKDPATQQAF

SEQ ID NO: 3012 - protein, 255 aa, Homo sapiens
MAALGPSSQNVTEYVVRVPKNTTKKYNIMAFNAADKVNFATWNQARLERDLSNKKIYQEEEMPESGAGSEFNRKLREEARRKKYGIVLKEFRPEDQPWLLRVNGKSGRKFKGIKKGGVTENTSYYIFTQCPDGAFEAFPVHNWYNFTPLARHRTLTAEEAEEEWERRNKVLNHFSIMQQRRLKDQDQDEDEEEKEKRGRRKASELRIHDLEDDLEMSSDASDASGEEGGRVPKAKKKAPLAKGGRKKKKKKGSDD

SEQ ID NO: 3013 - protein, 255 aa, Homo sapiens
MVVMARLSRPERPDLVFEEEDLPYEEEIMRNQFSVKCWLRYIEFKQGAPKPRLNQLYERALKLLPCSYKLWYRYLKARRAQVKHRCVTDPAYEDVNNCHERAFVFMHKMPRLWLDYCQFLMDQGRVTHTRRTFDRALRALPITQHSRIWPLYLRFLRSHPLPETAVRGYRRFLKLSPESAEEYIEYLKSSDRLDEAAQRLATVVNDERFVSKAGKSNYQLWHELCDLISQNPDKVQSLNVDAIIRGGLTRFTDQL

SEQ ID NO: 3014 - protein, 255 aa, Homo sapiens
MSNGYEDHMAEDCRGDIGRTNLIVNYLPQNMTQDELRSLFSSIGEVESAKLIRDKVAGHSLGYGFVNYVTAKDAERAINTLNGLRLQSKTIKVSYARPSSEVIKDANLYISGLPRTMTQKDVEDMFSRFGRIINSRVLVDQTTGLSRGVAFIRFDKRSEAEEAITSFNGHKPPGSSEPITVKFAANPNQNKNVALLSQLYHSPARRFGGPVHHQAQRFRFSPMGVDHMSGLSGVNVPGNASSGWCIFIYNLGQDA

SEQ ID NO: 3015 - protein, 255 aa, Homo sapiens
MAPACQILRWALALGLGLMFEVTHAFRSQDEFLSSLESYEIAFPTRVDHNGALLAFSPPPPRRQRRGTGATAESRLFYKVASPSTHFLLNLTRSSRLLAGHVSVEYWTREGLAWQRAARPHCLYAGHLQGQASSSHVAISTCGGLHGLIVADEEEYLIEPLHGGPKGSRSPEESGPHVVYKRSSLRHPHLDTACGVRDEKPWKGRPWWLRTLKPPPARPLGNETERGQPGLKRSVSRERYVETLVVADKMMVAYH

SEQ ID NO: 3016 - protein, 255 aa, Homo sapiens
MATLVELPDSVLLEIFSYLPVRDRIRISRVCHRWKRLVDDRWLWRHVDLTLYTMRPKVMWHLLRRYMASRLHSLRMGGYLFSGSQAPQLSPALLRALGQKCPNLKRLCLHVADLSMVPITSLPSTLRTLELHSCEISMAWLHKQQDPTVLPLLECIVLDRVPAFRDEHLQGLTRFRALRSLVLGGTYRVTETGLDAGLQELSYLQRLEVLGCTLSADSTLLAISRHLRDVRKIRLTVRGLSAPGLAVLEGMPALE

SEQ ID NO: 3017 - protein, 255 aa, Homo sapiens
MPARTAPARVPTLAVPAISLPDDVRRRLKDLERDSLTEKECVKEKLNLLHEFLQTEIKNQLCDLETKLRKEELSEEGYLAKVKSLLNKDLSLENGAHAYNREVNGRLENGNQARSEARRVGMADANSPPKPLSKPRTPRRSKSDGEAKRSRDPPASASQVTGIRAEPSPSPRITRKSTRQTTITSHFAKGPAKRKPQEESERAKSDESIKEEDKDQDEKRRRVTSRERVARPLPAEEPERAKSGTRTEKEEERDE

SEQ ID NO: 3018 - protein, 255 aa, Homo sapiens
MPLRHWGMARGSKPVGDGAQPMAAMGGLKVLLHWAGPGGGEPWVTFSESSLTAEEVCIHIAHKVGITPPCFNLFALFDAQAQVWLPPNHILEIPRDASLMLYFRIRFYFRNWHGMNPREPAVYRCGPPGTEASSDQTAQGMQLLDPASFEYLFEQGKHEFVNDVASLWELSTEEEIHHFKNESLGMAFLHLCHLALRHGIPLEEVAKKTSFKDCIPRSFRRHIRQHSALTRLRLRNVFRRFLRDFQPGRLSQQMV

SEQ ID NO: 3019 - protein, 255 aa, Homo sapiens
MQPDPRPSGAGACCRFLPLQSQCPEGAGDAVMYASTECKAEVTPSQHGNRTFSYTLEDHTKQAFGIMNELRLSQQLCDVTLQVKYQDAPAAQFMAHKVVLASSSPVFKAMFTNGLREQGMEVVSIEGIHPKVMERLIEFAYTASISMGEKCVLHVMNGAVMYQIDSVVRACSDFLVQQLDPSNAIGIANFAEQIGCVELHQRAREYIYMHFGEVAKQEEFFNLSHCQLVTLISRDDLNVRCESEVFHACINWVKY

SEQ ID NO: 3020 - protein, 255 aa, Homo sapiens
MGHRTAMPEPRGSSQLRVNAAFAARYNRYREREELQRLKDRYGDRDSSSDSSSESDSSDERVEFDPQQERDFYKTLSLLKKKDPRIYQKDATFYNRTASSSDSEEDPEALEKQKKVRPMYLKDYERKVILEKAGKYVDEENSDGETSNHRLQETSSQSYVEEQKQLKESFRAFVEDSEDEDGAGEGGSSLLQKRAKTRQEKAQEEADYIEWLKGQKEIRNPDSLKELTHLKEYWNDPELDEGERFLRDYILNKRY

SEQ ID NO: 3021 - protein, 189 aa, Homo sapiens
MEEGGNLGGLIKMVHLLVLSGAWGMQMWVTFVSGFLLFRSLPRHTFGLVQSKLFPFYFHISMGCAFINLCILASQHAWAQLTFWEASQLYLLFLSLTLATVNARWLEPRTTAAMWALQTVEKERGLGGEVPGSHQGPDPYRQLREKDPKYSALRQNFFRYHGLSSLCNLGCVLSNGLCLAGLALEIRSL

SEQ ID NO: 3022 - protein, 255 aa, Homo sapiens
MDAVAFEDVAVNFTQEEWALLGPSQKNLYRYVMQETIRNLDCIRMIWEEQNTEDQYKNPRRNLRCHMVERFSESKDSSQCGETFSLIRDSIVNNSICPGEDPCQSAECEEVIMGHLSLNSHIRVDSGHKPHEYQEYGEKPHTHKQRGKAFSYHHSFQSRGRPHTGKKRYECKECGKTFSSRRNLRRHMVVQGGNRPYKCKLCGKAFFWPSLLRMHERTHTGEKPYECKQCSKAFPFYSSYRRHERMHTGEKPYEC

SEQ ID NO: 3023 - protein, 255 aa, Homo sapiens
MGAYARASGVCARGCLDSAGPWTMSRALRPPLPPLCFFLLLLAAAGARAGGYETCPTVQPNMLNVHLLPHTHDDVGWLKTVDQYFYGIKNDIQHAGVQYILDSVISALLADPTRRFIYVEIAFFSRWWHQQTNATQEVVRDLVRQGRLEFANGGWVMNDEAATHYGAIVDQMTLGLRFLEDTFGNDGRPRVAWHIDPFGHSREQASLFAQMGFDGFFFGRLDYQDKWVRMQKLEMEQVWRASTSLKPPTADLFTG

SEQ ID NO: 3024 - protein, 106 aa, Homo sapiens
MSTNNMSDPRRPNKVLRYKPPPSECNPALDDPTPDYMNLLGMIFSMCGLMLKLKWCAWVAVYCSFISFANSRSSEDTKQMMSSFMLSISAVVMSYLQNPQPMTPPW

SEQ ID NO: 3025 - protein, 255 aa, Homo sapiens
MPIIPAFWEAEAGGSREEEFETSLANMIEKKLEPLSQDEDQHADLTQSRRPLTSCTIFLGYTSNLISSGIRETIRYLVQHNMVDVLVTTAGGVEEDLIKCLAPTYLGEFSLRGKELRENGINRIGNLLVPNENYCKFEDWLMPILDQMVMEQNTEGVKWTPSKMIARLGKEINNPESVYYWAQKNHIPVFSPALTDGSLGDMIFFHSYKNPGLVLDIVEDLRLINTQAIFAKCTGMIILGGGVVKHHIANANLMR

SEQ ID NO: 3026 - protein, 897 aa, Homo sapiens
MDWQPDEQGLQQVLQLLKDSQSPNTATQRIVQDKLKQLNQFPDFNNYLIFVLTRLKSEDEPTRSLSGLILKNNVKAHYQSFPPPVADFIKQECLNNIGDASSLIRATIGILITTIASKGELQMWPELLPQLCNLLNSEDYNTCEGAFGALQKICEDSSELLDSDALNRPLNIMIPKFLQFFKHCSPKIRSHAIACVNQFIMDRAQALMDNIDTFIEHLFALAVDDDPEVRKNVCRALVMLLEVRIDRLIPHMHSIIQYMLQRTQDHDENVALEACEFWLTLAEQPICKEVLASHLVQLIPILVNGMKYSEIDIILLKGDVEEDEAVPDSEQDIKPRFHKSRTVTLPHEAERPDGSEDAEDDDDDDALSDWNLRKCSAAALDVLANVFREELLPHLLPLLKGLLFHPEWVVKESGILVLGAIAEGCMQGMVPYLPELIPHLIQCLSDKKALVRSIACWTLSRYAHWVVSQPPDMHLKPLMTELLKRILDGNKRVQEAACSAFATLEEEACTELVPYLSYILDTLVFAFGKYQHKNLLILYDAIGTLADSVGHHLNQPEYIQKLMPPLIQKWNELKDEDKDLFPLLECLSSVATALQSGFLPYCEPVYQRCVTLVQKTLAQAMMYTQHPEQYEAPDKDFMIVALDLLSGLAEGLGGHVEQLVARSNIMTLLFQCMQDSMPEVRQSSFALLGDLTKACFIHVKPCIAEFMPILGTNLNPEFISVCNNATWAIGEICMQMGAEMQPYVQMVLNNLVEIINRPNTPKTLLENTGRLTSPSAIPAITIGRLGYVCPQEVAPMLQQFIRPWCTSLRNIRDNEEKDSAFRGICMMIGVNPGGVVQDFIFFCDAVASWVSPKDDLRDMFYKILHGFKDQVGEDNWQQFSEQFPPLLKERLAAFYGV

SEQ ID NO: 3027 - protein, 255 aa, Homo sapiens
MARLAAVLWNLCVTAVLVTSATQGLSRAGLPFGLMRRELACEGYPIELRCPGSDVIMVENANYGRTDDKICDADPFQMENVQCYLPDAFKIMSQRCNNRTQCVVVAGSDAFPDPCPGTYKYLEVQYDCVPYKVEQKVFVCPGTLQKVLEPTSTHESEHQSGAWCKDPLQAGDRIYVMPWIPYRTDTLTEYASWEDYVAARHTTTYRLPNRVDGTGFVVYDGAVFYNKERTRNIVKYDLRTRIKSGETVINTANYH

SEQ ID NO: 3028 - protein, 137 aa, Homo sapiens
MGAHLVRRYLGDASVEPDPLQMPTFPPDYGFPERKEREMVATQQEMMDAQLRLQLRDYCAHHLIRLLKCKRDSFPNFLACKQERHDWDYCEHRDYVMRMKEFERERRLLQRKKRREKKAAELAKGQGPGEVDPKVAL

SEQ ID NO: 3029 - protein, 255 aa, Homo sapiens
MDQGYGGYGAWSAGPANTQGAYGTGVASWQGYENYNYYGAQNTSVTTGATYSYGPASWEAAKANDGGLAAGAPAMHMASYGPEPCTDNSDSLIAKINQRLDMMSKEGGRGGSGGGGEGIQDRESSFRFQPFESYDSRPCLPEHNPYRPSYSYDYEFDLGSDRNGSFGGQYSECRDPARERGSLDGFMRGRGQGRFQDRSNPGTFMRSDPFVPPAASSEPLSTPWNELNYVGGRGLGGPSPSRPPPSLFSQSMAPD

SEQ ID NO: 3030 - protein, 255 aa, Homo sapiens
MSYTGFVQGSETTLQSTYSDTSAQPTCDYGYGTWNSGTNRGYEGYGYGYGYGQDNTTNYGYGMATSHSWEMPSSDTNANTSASGSASADSVLSRINQRLDMVPHLETDMMQGGVYGSGGERYDSYESCDSRAVLSERDLYRSGYDYSELDPEMEMAYEGQYDAYRDQFRMRGNDTFGPRAQGWARDARSGRPMASGYGRMWEDPMGARGQCMSGASRLPSLFSQNIIPEYGMFQGMRGGGAFPGGSRFGFGFGNG

SEQ ID NO: 3031 - protein, 255 aa, Homo sapiens
MASARKASRPMRDVFGDFSDVSLEDSTMEEIRNFQISRNLTKIAPGHSRFLKRNQTLDEKHLLLKENPVLGSGPRLASCRPPTTASRIRANAALMKLAQLETRIMNRKLQRNLSDTESDSMTADAGLPKRADRILSGGALELASQNTDKTSQNQARELPVTENNAQNAKVSRFLKKKQAPVENISPEAPAGKERTLQTPKQKEPARTFDSPDSDEEEMKVLLGSLMDSSREKNTNQGFSSANVSEEEERKLFSVP

SEQ ID NO: 3032 - protein, 157 aa, Homo sapiens
MDPRLPAWALVLLGPALVFALGPAPTPEMREKLCGHHFVRALVRVCGGPRWSTEARRPATGGDQRESHSVSQAGLKLLSSSNPPTLTFQSVGISDVSCYSGWRDDICSMGWWPTVISRWDLACSPCPRPLTITATTVQLPPTLHATAASVAVPNKTC

SEQ ID NO: 3033 - protein, 255 aa, Homo sapiens
MEPLVTWVVPLLFLFLLSRQGAACRTSECCFQDPPYPDADSGSASGPRDLRCYRISSDRYECSWQYEGPTAGVSHFLRCCLSSGRCCYFAAGSATRLQFSDQAGVSVLYTVTLWVESWARNQTEKSPEVTLQLYNSVKYEPPLGDIKVSKLAGQLRMEWETPDNQVGAEVQFRHRTPSSPWKLGDCGPQDDDTESCLCPLEMNVAQEFQLRRRQLGSQGSSWSKWSSPVCVPPENPPQPQVRFSVEQLGQDGRRR

SEQ ID NO: 3034 - protein, 255 aa, Homo sapiens
MASAAAAEAEKGSPVVVGLLVVGNIIILLSGLSLFAETIWVTADQYRVYPLMGVSGKDDVFAGAWIAIFCGFSFFMVASFGVGAALCRRRSMVLTYLVLMLIVYIFECASCITSYTHRDYMVSNPSLITKQMLTFYSADTDQGQELTRLWDRVMIEQECCGTSGPMDWVNFTSAFRAATPEVVFPWPPLCCRRTGNFIPLNEEGCRLGHMDYLFTKGCFEHIGHAIDSYTWGISWFGFAILMWTLPVMLIAMYFY

SEQ ID NO: 3035 - protein, 113 aa, Homo sapiens
MGGLEPCSRLLLLPLLLAVSGLRPVQAQAQSDCSCSTVSPGVLAGIVMGDLVLTVLIALAVYFLGRLVPRGRGAAEAATRKQRITETESPYQELQGQRSDVYSDLNTQRPYYK

SEQ ID NO: 3036 - protein, 255 aa, Homo sapiens
MANSSFIGDHVHGAPHAVMPEVEFPDQFFTVLTMDHELVTLRDVVINFSQEEWEYLDSAQRNLYWDVMMENYSNLLSLDLESRNETKHLSVGKDIIQNTGSQWEVMESSKLCGLEGSIFRNDWQSKSKIDLQGPEVGYFSQMKIISENVPSYKTHESLTLPRRTHDSEKPYEYKEYEKVFSCDLEFDEYQKIHTGGKNYECNQCWKTFGIDNSSMLQLNIHTGVKPCKYMEYGNTCSFYKDFNVYQKIHNEKFYK

SEQ ID NO: 3037 - protein, 255 aa, Homo sapiens
MAHELVMFRDVAIDVSQEEWECLNPAQRNLYKEVMLENYSNLVSLGLSVSKPAVISSLEQGKEPWMVVREETGRWCPGTWKTWGFHNNFLDNNEATDINADLASRDEPQKLSPKRDIYETELSQWVNMEEFKSHSPERSIFSAIWEGNCHFEQHQGQEEGYFRQLMINHENMPIFSQHTLLTQEFYDREKISECKKCRKIFSYHLFFSHHKRTHSKELSECKECTEIVNTPCLFKQQTIQNGDKCNECKECWKAF

SEQ ID NO: 3038 - protein, 255 aa, Homo sapiens
MSYGSITFGDVAIDFSHQEWEYLSLVQKTLYQEVMMENYDNLVSLAGHSVSKPDLITLLEQGKEPWMIVREETRGECTDLDSRCEIISDGKMQLYRKHSCVTLHQRIHNGQKPYECKQCQKSFSHLTELMVHQTIHTSEEPDQCEKFRKAFSHLTDLRKHQKINAREKPYECEECGKVFSYPANLAQHGKVHVEKPYECKECGEAFRTSRQLTVHHRFHYGEKPYECKECGKAFSVYGRLSRHQSIHTGEKPFEC

SEQ ID NO: 3039 - protein, 255 aa, Homo sapiens
MHPAGLAAAAAGTPRLPSKRRIPVSQPGMADPHQLFDDTSSAQSRGYGAQRAPGGLSYPAASPTPHAAFLADPVSNMAMAYGSSLAAQGKELVDKNIDRFIPITKLKYYFAVDTMYVGRKLGLLFFPYLHQDWEVQYQQDTPVAPRFDVNAPDLYIPAMAFITYVLVAGLALGTQDRFSPDLLGLQASSALAWLTLEVLAILLSLYLVTVNTDLTTIDLVAFLGYKYVGMIGGVLMGLLFGKIGYYLVLGWCCVA

SEQ ID NO: 3040 - protein, 148 aa, Homo sapiens; identical to SEQ ID NO: 2411

SEQ ID NO: 3041 - protein, 244 aa, Homo sapiens
MGPPSAAPRGGHRPWQGLLITASLLTFWHPPTTVQFTIEALPSSAAEGKDVLLLACNISETIQAYYWHKGKTAEGSPLIAGYITDIQANIPGAAYSGRETVYPNGSLLFQNITLEDAGSYTLRTINASYDSDQATGQLHVHQNNVPGLPVGAVAGIVTGVLVGVALVAALVCFLLLSRTGRASIQRDLREQPPPASTPGHGPSHRSTFSAPLPSPRTATPIYEELLYSDANIYCQIDHKADVVS

SEQ ID NO: 3042 - protein, 255 aa, Homo sapiens
MGHPPLLPLLLLLHTCVPASWGLRCMQCKTNGDCRVEECALGQDLCRTTIVRLWEEGEELELVEKSCTHSEKTNRTLSYRTGLKITSLTEVVCGLDLCNQGNSGRAVTYSRSRYLECISCGSSDMSCERGRHQSLQCRSPEEQCLDVVTHWIQEGEEGRPKDDRHLRGCGYLPGCPGSNGFHNNDTFHFLKCCNTTKCNEGPILELENLPQNGRQCYSCKGNSTHGCSSEETFLIDCRGPMNQCLVATGTHEPKN

SEQ ID NO: 3043 - protein, 173 aa, Homo sapiens
MADTVLFEFLHTEMVAELWAHDPDPGPGVSAGLRGEEAGATKGQKMSLSVLEGMGFRVGQALGERLPRETLAFREELDVLKFLCKDLWVAVFQKQMDSLRTNHQGTYVLQDNSFPLLLPMASGLQYLEEAPKFLAFTCGLLRGALYTLGIESVVTASVAALPVCKFQVVIPKS

SEQ ID NO: 3044 - protein, 255 aa, Homo sapiens
MDPGKDKEGVPQPSGPPARKKFVIPLDEDEVPPGVAKPLFRSTQSLPTVDTSAQAAPQTYAEYAISQPLEGAGATCPTGSEPLAGETPNQALKPGAKSNSIIVSPRQRGNPVLKFVRNVPWEFGDVIPDYVLGQSTCALFLSLRYHNLHPDYIHGRLQSLGKNFALRVLLVQVDVKDPQQALKELAKMCILADCTLILAWSPEEAGRYLETYKAYEQKPADLLMEKLEQDFVSRVTECLTTVKSVNKTDSQTLLT

SEQ ID NO: 3045 - protein, 255 aa, Homo sapiens
MGQVLPVFAHCKEAPSTASSTPDSTEGGNDDSDFRELHTAREFSEEDEEETTSQDWGTPRELTFSYIAFDGVVGSGGRRDSTARRPRPQGRSVSEPRDQHPQPSLGDSLESIPSLSQSPEPGRRGDPDTAPPSERPLEDLRLRLDHLGWVARGTGSGEDSSTSSSTPLEDEEPQEPNRLETGEAGEELDLRLRLAQPSSPEVLTPQLSPGSGTPQAGTPSPSRSRDSNSGPEEPLLEEEEKQWGPLEREPVRGQC

SEQ ID NO: 3046 - protein, 255 aa, Homo sapiens
MASGSGDSVTRRSVASQFFTQEEGPGIDGMTTSERVVDLLNQAALITNDSKITVLKQVQELIINKDPTLLDNFLDEIIAFQADKSIEVRKFVIGFIEEACKRDIELLLKLIANLNMLLRDENVNVVKKAILTMTQLYKVALQWMVKSRVISELQEACWDMVSAMAGDIILLLDSDNDGIRTHAIKFVEGLIVTLSPRMADSEIPRRQEHDISLDRIPRDHPYIQYNVLWEEGKAALEQLLKFMVHPAISSINLTT

SEQ ID NO: 3047 - protein, 196 aa, Homo sapiens
MSRRSMLLAWALPSLLRLGAAQETEDPACCSPIVPRNEWKALASECAQHLSLPLRYVVVSHTAGSSCNTPASCQQQARNVQHYHMKTLGWCDVGYNFLIGEDGLVYEGRGWNFTGAHSGHLWNPMSIGISFMGNYMDRVPTPQAIRAAQGLLACGVAQGALRSNYVLKGHRDVQRTLSPGNQLYHLIQNWPHYRSP

SEQ ID NO: 3048 - protein, 255 aa, Homo sapiens
MTRHGKNCTAGAVYTYHEKKKDTAASGYGTQNIRLSRDAVKDFDCCCLSLQPCHDPVVTPDGYLYEREAILEYILHQKKEIARQMKAYEKQRGTRREEQKELQRAASQDHVRGFLEKESAIVSRPLNPFTAKALSGTSPDDVQPGPSVGPPSKDKDKVLPSFWIPSLTPEAKATKLEKPSRTVTCPMSGKPLRMSDLTPVHFTPLDSSVDRVGLITRSERYVCAVTRDSLSNATPCAVLRPSGAVVTLECVEKLI

SEQ ID NO: 3049 - protein, 255 aa, Homo sapiens
MGEVEAPGRLWLESPPGGAPPIFLPSDGQALVLGRGPLTQVTDRKCSRTQVELVADPETRTVAVKQLGVNPSTTGTQELKPGLEGSLGVGDTLYLVNGLHPLTLRWEETRTPESQPDTPPGTPLVSQDEKRDAELPKKRMRKSNPGWENLEKLLVFTAAGVKPQGKVAGFDLDGTLITTRSGKVFPTGPSDWRILYPEIPRKLRELEAEGYKLVIFTNQMSIGRGKLPAEEFKAKVEAVVEKLGVPFQVLVATHA

SEQ ID NO: 3050 - protein, 165 aa, Homo sapiens
MELCRSLALLGGSLGLMFCLIALSTDFWFEAVGPTHSAHSGLWPTGHGDIISGYIHVTQTFSIMAVLWALVSVSFLVLSCFPSLFPPGHGPLVSTTAAFAAAISMVVAMAVYTSERWDQPPHPQIQTFFSWSFYLGWVSAILLLCTGALSLGAHCGGPRPGYETL

SEQ ID NO: 3051 - protein, 255 aa, Homo sapiens
METNSSLPTNISGGTPAVSAGYLFLDIITYLVFAVTFVLGVLGNGLVIWVAGFRMTHTVTTISYLNLAVADFCFTSTLPFFMVRKAMGGHWPFGWFLCKFVFTIVDINLFGSVFLIALIALDRCVCVLHPVWTQNHRTVSLAKKVIIGPWVMALLLTLPVIIRVTTVPGKTGTVACTFNFSPWTNDPKERINVAVAMLTVRGIIRFIIGFSAPMSIVAVSYGLIATKIHKQGLIKSSRPLRVLSFVAAAFFLCWS

SEQ ID NO: 3052 - protein, 255 aa, Homo sapiens
MALPQGLLTFRDVAIEFSQEEWKCLDPAQRTLYRDVMLENYRNLVSLDISSKCMMKTFFSTGQGNTEAFHTGTLQRQASHHIGDFCFQKIEKDIHGFQFQWKEDETNDHAAPMTEIKELTGSTGQHDQRHAGNKHIKDQLGLSFHSHLPELHIFQPEGKIGNQVEKSINNASSVSTSQRICCRPKTHISNKYGNNSLHSSLLTQKRNVHMREKSFQCIESGKSFNCSSLLKKHQITHLEEKQCKCDVYGKVFNQK

SEQ ID NO: 3053 - protein, 282 aa, Homo sapiens
MALVLILQLLTLWPLCHTDITPSVPPASYHPKPWLGAQPATVVTPGVNVTLRCRAPQPAWRFGLFKPGEIAPLLFRDVSSELAEFFLEEVTPAQGGSYRCCYRRPDWGPGVWSQPSDVLELLVTEELPRPSLVALPGPVVGPGANVSLRCAGRLRNMSFVLYREGVAAPLQYRHSAQPWADFTLLGARAPGTYSCYYHTPSAPYVLSQRSEVLVISWEGEGPEARPASSAPGMQAPGPPPSDPGAQAPSLSSFRPRGLVLQPLLPQTQDSWDPAPPPSDPGV

SEQ ID NO: 3054 - protein, 399 aa, Homo sapiens
MGSSRCGPGAHPVHLWPPHFAFSGHHPRDLGPHSGPALLVSLASEVQDLHLAQRKEMASGFSKGPTLGLLPDVPSLMETLSYSYCYVGIMTGPFFRYRTYLDWLEQPFPGAVPSLRPLLRRAWPAPLFGLLFLLSSHLFPLEAVREDAFYARPLPARLFYMIPVFFAFRMRFYVAWIAAECGCIAAGFGAYPVAAKARAGGGPTLQCPPPSSPEKAASLEYDYETIRNIDCYSTDFCVRVRDGMRYWNMTVQWWLAQYIYKSAPARSYVLRSAWTMLLSAYWHGLHPGYYLSFLTIPLCLAAEGRLESALRGRLSPGGQKAWDWVHWFLKMRAYDYMCMGFVLLSLADTLRYWASIYFCIHFLALAALGLGLALGGGSPSRRKAASQPTSLAPEKLREE

SEQ ID NO: 3055 - protein, 253 aa, Homo sapiens
MAPWSHPSAQLQPVGGDAVSPALMVLLCLGNLSKATLWAEPGSVISRGNSVTIRCQGTLEAQEYRLVKEGSPEPWDTQNPLEPKNKARFSIPSMTEHHAGRYRCYYYSPAGWSEPSDPLELVVTGFYNKPTLSALPSPVVTSGENVTLQCGSRLRFDRFILTEEGDHKLSWTLDSQLTPSGQFQALFPVGPVTPSHRWMLRCYGSRRHILQVWSEPSDLLEIPVSGEEATVFSSTIQGSQTGCGELYRQGSPC

SEQ ID NO: 3056 - protein, 255 aa, Homo sapiens
MTLILTSLLFFGLSLGPRTRVQAENLPKPILWAEPGPVITWHNPVTIWCQGTLEAQGYRLDKEGNSMSRHILKTLESENKVKLSIPSMMWEHAGRYHCYYQSPAGWSEPSDPLELVVTAYSRPTLSALPSPVVTSGVNVTLRCASRLGLGRFTLIEEGDHRLSWTLNSHQHNHGKFQALFPMGPLTFSNRGTFRCYGYENNTPYVWSEPSDPLQLLVSGVSRKPSLLTLQGPVVTPGENLTLQCGSDVGYIRYTL

SEQ ID NO: 3057 - protein, 413 aa, Homo sapiens
MLVTFKDVAVTFTREEWRQLDLAQRTLYREVMLETCGLLVSLGHRVPKPELVHLLEHGQELWIVKRGLSHATCAGDRAQVHTREPTTYPPVLSERAFLRGSLTLESSTSSDSRLGRARDEEGLLEMQKGKVTPETDLHKETHLGKVSLEGEGLGTDDGLHSRALQEWLSADVLHECDSQQPGKDALIHAGTNPYKCKQCGKGFNRKWYLVRHQRVHTGMKPYECNACGKAFSQSSTLIRHYLIHTGEKPYKCLECGKAFKRRSYLMQHHPIHTGEKPYECSQCRKAFTHRSTFIRHNRTHTGEKPFECKECEKAFSNRAHLIQHYIIHTGEKPYDCMACGKAFRCSSELIQHQRIHTGEKPYECTQCGKAFHRSTYLIQHSVIHTGEMPYKCIECGKAFKRRSHLLQHQRVHT

SEQ ID NO: 3058 - protein, 255 aa, Homo sapiens
MAAAVLRDSTSVPVTAEAKLMGFTQGCVTFEDVAIYFSQEEWGLLDEAQRLLYRDVMLENFALITALVCWHGMEDEETPEQSVSVEGVPQVRTPEASPSTQKIQSCDMCVPFLTDILHLTDLPGQELYLTGACAVFHQDQKHHSAEKPLESDMDKASFVQCCLFHESGMPFTSSEVGKDFLAPLGILQPQAIANYEKPNKISKCEEAFHVGISHYKWSQCRRESSHKHTFFHPRVCTGKRLYESSKCGKACCCEC

SEQ ID NO: 3059 - protein, 255 aa, Homo sapiens
MAAAELTAPAQGIVTFEDVAVYFSWKEWGLLDEAQKCLYHDVMLENLTLTTSLGGSGAGDEEAPYQQSTSPQRVSQVRIPKALPSPQKTNPCEICGPVLRQILHLVEHQGTHHGQKLYTDGACRKQLQFTAYLHQHQKQHVGQKHFRSNGGRDMFLSSCTFEVSGKPFTCKEVGKDFLVRSRFLQQQAAHTRKKSNRTKSAVAFHSVKNHYNWGECVKAFSYKHVRVQHQGDLIRERSYMCSECGKSFSTSCSLS

SEQ ID NO: 3060 - protein, 255 aa, Homo sapiens
MRLKMTTRNFPEREVPCDVEVERFTREVPCLSSLGDGWDCENQEGHLRQSALTLEKPGTQEAICEYPGFGEHLIASSDLPPSQRVLATNGFHAPDSNVSGLDCDPALPSYPKSYADKRTGDSDACGKGFNHSMEVIHGRNPVREKPYKYPESVKSFNHFTSLGHQKIMKRGKKSYEGKNFENIFTLSSSLNENQRNLPGEKQYRCTECGKCFKRNSSLVLHHRTHTGEKPYTCNECGKSFSKNYNLIVHQRIHTG

SEQ ID NO: 3061 - protein, 255 aa, Homo sapiens
MPVHTLSPGAPSAPALPCRLRTRVPGYLLRGPADGGARKPSAVERLEADKAKYVKSLHVANTRQEPVQPLLSKQPLFSPETRRTVLTPSRRALPGPCRRPQLDLDILSSLIDLCDSPVSPAEASRTPGRAEGAGRPPPATPPRPPPSTSAVRRVDVRPLPASPARPCPSPGPAAASSPARPPGLQRSKSDLSERFSRAAADLERFFNFCGLDPEEARGLGVAHLARASSDIVSLAGPSAGPGSSEGGCSRRSSVT

SEQ ID NO: 3062 - protein, 194 aa, Homo sapiens
MAASLVGKKIVFVTGNAKKLEEVVQILGDKFPCTLVAQKIDLPEYQGEPDEISIQKCQEAVRQVQGPVLVEDTCLCFNALGGLPGPYIKWFLEKLKPEGLHQLLAGFEDKSAYALCTFALSTGDPSQPVRLFRGRTSGRIVAPRGCQDFGWDPCFQPDGYEQTYAEMPKAEKNAVSHRFRALLELQEYFGSLAA

SEQ ID NO: 3063 - protein, 255 aa, Homo sapiens
MEVPQPEPAPGSALSPAGVCGGAQRPGHLPGLLLGSHGLLGSPVRAAASSPVTTLTQTMHDLAGLGSETPKSQVGTLLFRSRSRLTHLSLSRRASESSLSSESSESSDAGLCMDSPSPMDPHMAEQTFEQAIQAASRIIRNEQFAIRRFQSMPVRLLGHSPVLRNITNSQAPDGRRKSEAGSGAASSSGEDKENDGFVFKMPWKPTHPSSTHALAEWASRREAFAQRPSSAPDLMCLSPDRKMEVEELSPLALGR

SEQ ID NO: 3064 - protein, 445 aa, Homo sapiens
MTELRQRVAHEPVAPPEDKESESEAKVDGETASDSESRAESAPLPVSADDTPEVLNRALSNLSSRWKNWWVRGILTLAMIAFFFIIIYLGPMVLMIIVMCVQIKCFHEIITIGYNVYHSYDLPWFRTLSWYFLLCVNYFFYGETVTDYFFTLVQREEPLRILSKYHRFISFTLYLIGFCMFVLSLVKKHYRLQFYMFGWTHVTLLIVVTQSHLVIHNLFEGMIWFIVPISCVICNDIMAYMFGFFFGRTPLIKLSPKKTWEGFIGGFFATVVFGLLLSYVMSGYRCFVCPVEYNNDTNSFTVDCEPSDLFRLQEYNIPGVIQSVIGWKTVRMYPFQIHSIALSTFASLIGPFGGFFASGFKRAFKIKDFANTIPGHGGIMDRFDCQYLMATFVNVYIASFIRGPNPSKLIQQFLTLRPDQQLHIFNTLRSHLIDKGMLTSTTEDE

SEQ ID NO: 3065 - protein, 255 aa, Homo sapiens
MLALRVARGSWGALRGAAWAPGTRPSKRRACWALLPPVPCCLGCLAERWRLRPAALGLRLPGIGQRNHCSGAGKAAPRPAAGAGAAAEAPGGQWGPASTPSLYENPWTIPNMLSMTRIGLAPVLGYLIIEEDFNIALGVFALAGLTDLLDGFIARNWANQRSALGSALDPLADKILISILYVSLTYADLIPVPLTYMIISRDVMLIAAVFYVRYRTLPTPRTLAKYFNPCYATARLKPTFISKVNTAVQLILVAA

SEQ ID NO: 3066 - protein, 81 aa, Homo sapiens
MSRSSKVVLGLSVLLTAATVAGVHVKQQWDQQRLRDGVIRDIERQIRKKENIRLLGEQIILTEQLEAEREKMLLAKGSQKS

SEQ ID NO: 3067 - protein, 255 aa, Homo sapiens
MATYLEFIQQNEERDGVRFSWNVWPSSRLEATRMVVPLACLLTPLKERPDLPPVQYEPVLCSRPTCKAVLNPLCQVDYRAKLWACNFCFQRNQFPPAYGGISEVNQPAELMPQFSTIEYVIQRGAQSPLIFLYVVDTCLEEDDLQALKESLQMSLSLLPPDALVGLITFGRMVQVHELSCEGISKSYVFRGTKDLTAKQIQDMLGLTKPAMPMQQARPAQPQEHPFASSRFLQPVHKIDMNLTDLLGELQRDPWP

SEQ ID NO: 3068 - protein, 255 aa, Homo sapiens
MRPSGDEDRARRRRRRRRRRDLLLSQLCFLASVALLLWSLSSLREQKELDLMDLVGEDRKWMMARKLMQVNDTLTSEDAGLRNSKNCTEPALHEFPNDIFTNEDRRQGAVVLHVLCAIYMFYALAIVCDDFFVPSLEKICERLHLSEDVAGATFMAAGSSAPELFTSVIGVFITKGDVGVGTIVGSAVFNILCIIGVCGLFAGQVVALSSWCLLRDSIYYTLSVIALIVFIYDEKVSWWESLVLVLMYLIYIVIM

SEQ ID NO: 3069 - protein, 255 aa, Homo sapiens
MGGRSSCEDPGCPRDEERAPRMGCMKSKFLQVGGNTFSKTETSASPHCPVYVPDPTSTIKPGPNSHNSNTPGIREAGSEDIIVVALYDYEAIHHEDLSFQKGDQMVVLEESGEWWKARSLATRKEGYIPSNYVARVDSLETEEWFFKGISRKDAERQLLAPGNMLGSFMIRDSETTKGSYSLSVRDYDPRQGDTVKHYKIRTLDNGGFYISPRSTFSTLQELVDHYKKGNDGLCQKLSVPCMSSKPQKPWEKDAW

SEQ ID NO: 3070 - protein, 85 aa, Homo sapiens
MKDKQKKKKERTWAEAARLVLENYSDAPMTPKQILQVIEAEGLKEMRSGTSPLACLNAMLHSNSRGGEGLFYKLPGRISLFTLKV

SEQ ID NO: 3071 - protein, 255 aa, Homo sapiens
MGLPEERVRSGSGSRGQEEAGAGGRARSWSPPPEVSRSAHVPSLQRYRELHRRSVEEPREFWGDIAKEFYWKTPCPGPFLRYNFDVTKGKIFIEWMKGATTNICYNVLDRNVHEKKLGDKVAFYWEGNEPGETTQITYHQLLVQVCQFSNVLRKQGIQKGDRVAIYMPMIPELVVAMLACARIGALHSIVFAGFSSESLCERILDSSCSLLITTDAFYRGEKLVNLKELADEALQKCQEKGFPVRCCIVVKHLGR

SEQ ID NO: 3072 - protein, 384 aa, Homo sapiens
MAAVQMDPELAKRLFFEGATVVILNMPKGTEFGIDYNSWEVGPKFRGVKMIPPGIHFLHYSSVDKANPKEVGPRMGFFLSLHQRGLTVLRWSTLREEVDLSPAPESEVEAMRANLQELDQFLGPYPYATLKKWISLTNFISEATVEKLQPENRQICAFSDVLPVLSMKHTKDRVGQNLPRCGIECKSYQEGLARLPEMKPRAGTEIRFSELPTQMFPEGATPAEITKHSMDLSYALETVLNKQFPSSPQDVLGELQFAFVCFLLGNVYEAFEHWKRLLNLLCRSEAAMMKHHTLYINLISILYHQLGEIPADFFVDIVSQDNFLTSTLQVFFSSACSIAVDATLRKKAEKFQAHLTKKFRWDFAAEPEDCAPVVVELPEGIEMG

SEQ ID NO: 3073 - protein, 237 aa, Homo sapiens
MSDSDLGEDEGLLSLAGKRKRRGNLPKESVKILRDWLYLHRYNAYPSEQEKLSLSGQTNLSVLQICNWFINARRRLLPDMLRKDGKDPNQFTISRRGGKASDVALPRGSSPSVLAVSVPAPTNVLSLSVCSMPLHSGQGEKPAAPFPRGELESPKPLVTPGSTLTLLTRAEAGSPTGGLFNTPPPTPPEQDKEDFSSFQLLVEVALQRAAEMELQKQQDPSLPLLHTPIPLVSENPQ

SEQ ID NO: 3074 - protein, 143 aa, Homo sapiens
MSGGRRKEEPPQPQLANGALKVSVWSKVLRSDAAWEDKDEFLDVIYWFRQIIAVVLGVIWGVLPLRGFLGIAGSFGSSFTLPSIMTDGVQLPSAPYPVQRTLLITAQELDRWGTPAPWNLEDPCFLDRESVCWASVFSARVVT

SEQ ID NO: 3075 - protein, 255 aa, Homo sapiens
MAPPGSSTVFLLALTIIASTWALTPTHYLTKHDVERLKASLDRPFTNLESAFYSIVGLSSLGAQVPDAKKACTYIRSNLDPSNVDSLFYAAQASQALSGCEISISNETKDLLLAAVSEDSSVTQIYHAVAALSGFGLPLASQEALSALTARLSKEETVLATVQALQTASHLSQQADLRSIVEEIEDLVARLDELGGVYLQFEEGLETTALFVAATYKLMDHVGTEPSIKEDQVIQLMNAIFSKKNFESLSEAFSV

SEQ ID NO: 3076 - protein, 255 aa, Homo sapiens
MDVGELLSYQPNRGTKRPRDDEEEEQKMRRKQTGTRERGRYREEEMTVVEEADDDKKRLLQIIDRDGEEEEEEEEPLDESSVKKMILTFEKRSYKNQELRIKFPDNPEKFMESELDLNDIIQEMHVVATMPDLYHLLVELNAVQSLLGLLGHDNTDVSIAVVDLLQELTDIDTLHESEEGAEVLIDALVDGQVVALLVQNLERLDESVKEEADGVHNTLAIVENMAEFRPEMCTEGAQQGLLQWLLKRLKAKMPF

SEQ ID NO: 3077 - protein, 255 aa, Homo sapiens
MAANVFPFRDARAAPDPVLEAGPVAHGPLPVPLVLDNGSFQVRAGWACPGQDPGPEPRLQFRAVCARGRGGARGASGPQVGNALGSLEPLRWMLRSPFDRNVPVNLELQELLLDYSFQHLGVSSQGCVDHPIVLTEAVCNPLYSRQMMSELLFECYGIPKVAYGIDSLFSFYHNKPKNSMCSGLIISSGYQCTHVLPILEGRLDAKNCKRINLGGSQAAGYLQRLLQLKYPGHLAAITLSRMEEILHEHSYIAED

SEQ ID NO: 3078 - protein, 255 aa, Homo sapiens
MASHVDLLTELQLLEKVPTLERLRAAQKRRAQQLKKWAQYEQDLQHRKRKHERKRSTGGRRKKVSFEASVALLEASLRNDAEEVRYFLKNKVSPDLCNEDGLTALHQCCIDNFEEIVKLLLSHGANVNAKDNELWTPLHAAATCGHINLVKILVQYGADLLAVNSDGNMPYDLCEDEPTLDVIETCMAYQGITQEKINEMRVAPEQQMIADIHCMIAAGQDLDWIDAQGATLLHIAGANGYLRAAELLLDHGVRV

SEQ ID NO: 3079 - protein, 255 aa, Homo sapiens
MAAPVGPVKFWRPGTEGPGVSISEERQSLAENSGTTVVYNPYAALSIEQQRQKLPVFKYLAEAGWTAEGRVVGVTQPRRVAAVTVAGRVAEERGAVLGHEVGYCIRFDDCTDQLATRIKFLTDGMLVREMMVDPLLTKYSVIMLDEAHERTLYTDIAIGLLKKIQKKRGDLRLIVASATLDADKFRDFFNQNETSDPARDTCVILTVEGRTFPVDIFYLQSPVPDYIKSTVETVVKIHQTEGDGDVLAFLTGQEE

SEQ ID NO: 3080 - protein, 255 aa, Homo sapiens
MAGAASPCANGCGPGAPSDAEVLHLCRSLEVGTVMTLFYSKKSQRPERKTFQVKLETRQITWSRGADKIEGAIDIREIKEIRPGKTSRDFDRYQEDPAFRPDQSHCFVILYGMEFRLKTLSLQATSEDEVNMWIKGLTWLMEDTLQAPTPLQIERWLRKQFYSVDRNREDRISAKDLKNMLSQVNYRVPNMRFLRERLTDLEQRSGDITYGQFAQLYRSLMYSAQKTMDLPFLEASTLRAGERPELCRVSLPEFQ

SEQ ID NO: 3081 - protein, 255 aa, Homo sapiens
MSRRTRCEDLDELHYQDTDSDVPEQRDSKCKVKWTHEEDEQLRALVRQFGQQDWKFLASHFPNRTDQQCQYRWLRVLNPDLVKGPWTKEEDQKVIELVKKYGTKQWTLIAKHLKGRLGKQCRERWHNHLNPEVKKSCWTEEEDRIICEAHKVLGNRWAEIAKMLPGRTDNAVKNHWNSTIKRKVDTGGFLSESKDCKPPVYLLLELEDKDGLQSAQPTEGQGSLLTNWPSVPPTIKEEENSEEELAAATTSKEQE

SEQ ID NO: 3082 - protein, 76 aa, Homo sapiens
MAGQFRSYVWDPLLILSQIVLMQTVYYGSLGLWLALVDGLVRSSPSLDQMFDAEILGFSTPPGRLSMMSFILNALT

SEQ ID NO: 3083 - protein, 255 aa, Homo sapiens
MGATGDAEQPRGPSGAERGGLELGDAGAAGQLVLTNPWNIMIKHRQVQRRGRRSQMTTSFTDPAISMDLLRAVLQPSINEEIQTVFNKYMKFFQKAALNVRDNVGEEVDAEQLIQEACRSCLEQAKLLFSDGEKVIPRLTHELPGIKRGRQAEEECAHRGSPLPKKRKGRPPGHILSSDRAAAGMVWKPKSCEPIRREGPKWDPARLNESTTFVLGSRANKALGMGGTRGRIYIKHPHLFKYAADPQDKHWLAEQ

SEQ ID NO: 3084 - protein, 255 aa, Homo sapiens
MIRAAPPPLFLLLLLLLLLVSWASRGEAAPDQDEIQRLPGLAKQPSFRQYSGYLKGSGSKHLHYWFVESQKDPENSPVVLWLNGGPGCSSLDGLLTEHGPFLVQPDGVTLEYNPYSWNLIANVLYLESPAGVGFSYSDDKFYATNDTEVAQSNFEALQDFFRLFPEYKNNKLFLTGESYAGIYIPTLAVLVMQDPSMNLQGLAVGNGLSSYEQNDNSLVYFAYYHGLLGNRLWSSLQTHCCSQNKCNFYDNKDLE

SEQ ID NO: 3085 - protein, 255 aa, Homo sapiens
MSLWQPLVLVLLVLGCCFAAPRQRQSTLVLFPGDLRTNLTDRQLAEEYLYRYGYTRVAEMRGESKSLGPALLLLQKQLSLPETGELDSATLKAMRTPRCGVPDLGRFQTFEGDLKWHHHNITYWIQNYSEDLPRAVIDDAFARAFALWSAVTPLTFTRVYSRDADIVIQFGVAEHGDGYPFDGKDGLLAHAFPPGPGIQGDAHFDDDELWSLGKGVVVPTRFGNADGAACHFPFIFEGRSYSACTTDGRSDGLPW

SEQ ID NO: 3086 - protein, 255 aa, Homo sapiens
MVLAQRRRGGCEKLRAGPQAVLASGSGFCDNMLADLGLIGTIGEDDEVPVEPESDSGDEEEEGPIVLGRRQKALGKNRSADFNPDFVFTEKEGTYDGSWALADVMSQLKKKRAATTLDEKIEKVRKKRKTEDKEAKSGKLEKEKEAKEGSEPKEQEDLQENDEEGSEDEASETDYSSADENILTKADTLKVKDRKKKKKKGQEAGGFFEDASQYDENLSFQDMNLSRPLLKAITAMGFKQPTPIQKACIPVGLLG

SEQ ID NO: 3087 - protein, 255 aa, Homo sapiens
MGEKMAEEERFPNTTHEGFNVTLHTTLVVTTKLVLPTPGKPILPVQTGEQAQQEEQSSGMTIFFSLLVLAICIILVHLLIRYRLHFLPESVAVVSLGILMGAVIKIIEFKKLANWKEEEMFRPNMFFLLLLPPIIFESGYSLHKGNFFQNIGSITLFAVFGTAISAFVVGGGIYFLGQGFFFVCVCVFVCFILQADVISKLNMTDSFAFGSLISAVDPVATIAIFNALHVDPVLNMLVFGESILNDAVSIVLTNT

SEQ ID NO: 3088 - protein, 228 aa, Homo sapiens
MAAQQRDCGGAAQLAGPAAEADPLGRFTCPVCLEVYEKPVQVPCGHVFCSACLQECLKPKKPVCGVCRSALAPGVRAVELERQIESTETSCHGCRKNFFLSKIRSHVATCSKYQNYIMEGVKATIKDASLQPRNVPNRYTFPCPYCPEKNFDQEGLVEHCKLFHSTDTKSVVCPICASMPWGDPNYRSANFREHIQRRHRFSYDTFVDYDVDEEDMMNQVLQRSIIDQ

SEQ ID NO: 3089 - protein, 255 aa, Homo sapiens
MEMEKEFEQIDKSGSWAAIYQDIRHEASDFPCRVAKLPKNKNRNRYRDVSPFDHSRIKLHQEDNDYINASLIKMEEAQRSYILTQGPLPNTCGHFWEMVWEQKSRGVVMLNRVMEKGSLKCAQYWPQKEEKEMIFEDTNLKLTLISEDIKSYYTVRQLELENLTTQETREILHFHYTTWPDFGVPESPASFLNFLFKVRESGSLSPEHGPVVVHCSAGIGRSGTFCLADTCLLLMDKRKDPSSVDIKKVLLEMRK

SEQ ID NO: 3090 - protein, 255 aa, Homo sapiens
MPRRKQQAPKRAAGYAQEEQLKEEEEIKEEEEEEDSGSVAQLQGGNDTGTDEELETGPEQKGCFSYQNSPGSHLSNQDAENESLLSDASDQVSDIKSVCGRDASDKKAHTHVRLPNEAHNCMDKMTAVYANILSDSYWSGLGLGFKLSNSERRNCDTRNGSNKSDFDWHQDALSKSLQQNLPSRSVSKPSLFSSVQLYRQSSKMCGTVFTGASRFRCRQCSAAYDTLVELTVHMNETGHYQDDNRKKDKLRPTSY

SEQ ID NO: 3091 - protein, 134 aa, Homo sapiens
MAATMKKAAAEDVNVTFEDQQKINKFARNTSRITELKEEIEVKKKQLQNLEDACDDIMLADDDCLMIPYQIGDVFISHSQEETQEMLEEAKKNLQEEIDALESRVESIQRVLADLKVQLYAKFGSNINLEADES

SEQ ID NO: 3092 - protein, 255 aa, Homo sapiens
MYRTKVGLKDRQQLYKLIISQLLYDGYISIANGLINEIKPQSVCAPSEQLLHLIKLGMENDDTAVQYAIGRSDTVAPGTGIDLEFDADVQTMSPEASEYETCYVTSHKGPCRVATYSRDGQLIATGSADASIKILDTERMLAKSAMPIEVMMNETAQQNMENHPVIRTLYDHVDEVTCLAFHPTEQILASGSRDYTLKLFDYSKPSAKRAFKYIQEAEMLRSISFHPSGDFILVGTQHPTLRLYDINTFQCFVSC

SEQ ID NO: 3093 - protein, 255 aa, Homo sapiens
MKGTGIMDCAPKALLARALYDNCPDCSDELAFSRGDILTILEQHVPESEGWWKCLLHGRQGLAPANRLQILTEVAADRPCPPFLRGLEEAPASSEETYQVPTLPRPPTPGPVYEQMRSWAEGPQPPTAQVYEFPDPPTSARIICEKTLSFPKQAILTLPRPVRASLPTLPSQVYDVPTQHRGPVVLKEPEKQQLYDIPASPKKAGLHPPDSQASGQGVPLISVTTLRRGGYSTLPNPQKSEWIYDTPVSPGKASV

SEQ ID NO: 3094 - protein, 255 aa, Homo sapiens
MGVRNCLYGNNMSGQRDIPPEIGEQPEQPPLEAPGAAAPGAGPSPAEEMETEPPHNEPIPVENDGEACGPPEVSRPNFQVLNPAFREAGAHGSYSPPPEEAMPFEAEQPSLGGFWPTLEQPGFPSGVHAGLEAFGPALMEPGAFSGARPGLGGYSPPPEEAMPFEFDQPAQRGCSQLLLQVPDLAPGGPGAAGVPGAPPEEPQALRPAKAGSRGGYSPPPEETMPFELDGEGFGDDSPPPGLSRVIAQVDGSSQF

SEQ ID NO: 3095 - protein, 255 aa, Homo sapiens
MNAGPSWNKVQHSKNSSGKRQSKSQVPHASSQPRSSLTAVTQPTEEKLKESISPEARRKRNPLGSRCQGASGNKLFLDFQSMKIIKENADEDSASDLSDSERIPIPPSPLTPPDLNLRAEEIDPVYFDLHPGQGHTKPEYYYPNFLPSPFSSWDLRDMALLLNAENKTEAVPRVGGLLGKYIDRLIQLEWLQVQTVQCEKAKGGKARPPTAPGTSGALKSPGRSKLIASALSKPLPHQEGASKSGPSRKKAFHHE

SEQ ID NO: 3096 - protein, 255 aa, Homo sapiens
MAMRSGRHPSLLLLLVLLLWLLQVSIIDSVQQETDDLTKQTKEKIYQPLRRSKRRWVITTLELEEEDPGPFPKLIGELFNNMSYNMSLMYLISGPGVDEYPEIGLFSLEDHENGRIYVHRPVDREMTPSFTVYFDVVERSTGKIVDTSLIFNIRISDVNDHAPQFPEKEFNITVQENQSAGQPIFQMLAVDLDEENTPNSQVLYFLISQTPLLKESGFRVDRLSGEIRLSGCLDYETAPQFTLLIRARDCGEPSL

SEQ ID NO: 3097 - protein, 126 aa, Homo sapiens
MVALFQHSPYWQADGYGHSHRLKCQHFKQHRQYNDKLEISSNLGPQFNALLNILLNIVHPTLSHDTRRSKGLKIEGLLQSRELGNSWTVTMCIWVLKALQSSAPNKPLDWLDPMPCFQNLLARGTP

SEQ ID NO: 3098 - protein, 255 aa, Homo sapiens
MASPRTRKVLKEVRVQDENNVCFECGAFNPQWVSVTYGIWICLECSGRHRGLGVHLSFVRSVTMDKWKDIELEKMKAGGNAKFREFLESQEDYDPCWSLQEKYNSRAAALFRDKVVALAEGREWSLESSPAQNWTPPQPRTLPSMVHRVSGQPQSVTASSDKAFEDWLNDDLGSYQGAQGNRYVGFGNTPPPQKKEDDFLNNAMSSLYSGWSSFTTGASRFASAAKEGATKFGSQASQKASELGHSLNENVLKPA

SEQ ID NO: 3099 - protein, 255 aa, Homo sapiens
MNKKKKPFLGMPAPLGYVPGLGRGATGFTTRSDIGPARDANDPVDDRHAPPGKRTVGDQMKKNQAADDDDEDLNDTNYDEFNGYAGSLFSSGPYEKDDEEADAIYAALDKRMDERRKERREQREKEEIEKYRMERPKIQQQFSDLKRKLAEVTEEEWLSIPEVGDARNKRQRNPRYEKLTPVPDSFFAKHLQTGENHTSVDPRQTQFGGLNTPYPGGLNTPYPGGMTPGLMTPGTGELDMRKIGQARNTLMDMRL

SEQ ID NO: 3100 - protein, 255 aa, Homo sapiens
MAAERQEALREFVAVTGAEEDRARFFLESAGWDLQIALASFYEDGGDEDIVTISQATPSSVSRGTAPSDNRVTSFRDLIHDQDEDEEEEEGQRFYAGGSERSGQQIVGPPRKKSPNELVDDLFKGAKEHGAVAVERVTKSPGETSKPRPFAGGGYRLGAAPEEESAYVAGEKRQHSSQDVHVVLKLWKSGFSLDNGELRSYQDPSNAQFLESIRRGEVPAELRRLAHGGQVNLDMEDHRDEDFVKPKGAFKAFTG

SEQ ID NO: 3101 - protein, 197 aa, Homo sapiens
MPIPASPLHPPLPSLLLYLLLELAGVTHVFHVQQTEMSQTVSTGESIILSCSVPNTLPNGPVLWFKGTGPNRKLIYNFKQGNFPRVKEIGDTTKPGNTDFSTRIREISLADAGTYYCVKFIKGRAIKEYQSGRGTQVFVTEQNPRPPKNRPAGRAGSRAHHDAHTCLSALPERNSTNYFVQPCCCLRLLGLTGLLSK

SEQ ID NO: 3102 - protein, 255 aa, Homo sapiens
MPVPASWPHPPGPFLLLTLLLGLTEVAGEEELQMIQPEKLLLVTVGKTATLHCTVTSLLPVGPVLWFRGVGPGRELIYNQKEGHFPRVTTVSDLTKRNNMDFSIRISSITPADVGTYYCVKFRKGSPENVEFKSGPGTEMALGAKPSAPVVLGPAARTTPEHTVSFTCESHGFSPRDITLKWFKNGNELSDFQTNVDPTGQSVAYSIRSTARVVLDPWDVRSQVICEVAHVTLQGDPLRGTANLSEAIRVPPTLE

SEQ ID NO: 3103 - protein, 169 aa, Homo sapiens
MLNKSGESRYPALFPVLGGSSMSSDFPHYNFRMPNIGFQNLPLNIYIVVFGTAIFVFILSLLFCCYLIRLRHQAHKEFYAYKQVILKEKVKELNLHELCAVCLEDFKPRDELGICPCKHAFHRKCLIKWLEVRKVCPLCNMPVLQLAQLHSKQDRGPPQGPLPGAENIV

SEQ ID NO: 3104 - protein, 255 aa, Homo sapiens
MDYSHQTSLVPCGQDKYISKNELLLHLKTYNLYYEGQNLQLRHREEEDEFIVEGLLNISWGLRRPIRLQMQDDNERIRPPPSSSSWHSGCNLGAQGTTLKPLTVPKVQISEVDAPPEGDQMPSSTDSRGLKPLQEDTPQLMRTRSDVGVRRRGNVRTPSDQRRIRRHRFSINGHFYNHKTSVFTPAYGSVTNVRINSTMTTPQVLKLLLNKFKIENSAEEFALYVVHTSGEKQKLKATDYPLIARILQGPCEQIS

SEQ ID NO: 3105 - protein, 349 aa, Homo sapiens
MAGGRCGPQLTALLAAWIAAVAATAGPEEAALPPEQSRVQPMTASNWTLVMEGEWMLKFYAPWCPSCQQTDSEWEAFAKNGEILQISVGKVDVIQEPGLSGRFFVTTLPAFFHAKDGIFRRYRGPGIFEDLQNYILEKKWQSVEPLTGWKSPASLTMSGMAGLFSISGKIWHLHNYFTVTLGIPAWCSYVFFVIATLVFGLFMGLVLVVISECFYVPLPRHLSERSEQNRRSEEAHRAEQLQDAEEEKDDSNEEENKDSLVDDEEEKEDLGDEDEAEEEEEEDNLAAGVDEERSEANDQGPPGEDGVTREEVEPEEAEEGISEQPCPADTEVVEDSLRQRKSQHADKGL

SEQ ID NO: 3106 - protein, 255 aa, Homo sapiens
MRSPRTRGRSGRPLSLLLALLCALRAKVCGASGQFELEILSMQNVNGELQNGNCCGGARNPGDRKCTRDECDTYFKVCLKEYQSRVTAGGPCSFGSGSTPVIGGNTFNLKASRGNDRNRIVLPFSFAWPRSYTLLVEAWDSSNDTVQPDSIIEKASHSGMINPSRQWQTLKQNTGVAHFEYQIRVTCDDYYYGFGCNKFCRPRDDFFGHYACDQNGNKTCMEGWMGPECNRAICRQGCSPKHGSCKLPGDCRCQY

SEQ ID NO: 3107 - protein, 255 aa, Homo sapiens
MFSRRSHGDVKKSTQKVLDPKKDVLTRLKHLRALLDNVDANDLKQFFETNYSQIYFIFYENFIALENSLKLKGNNKSQREELDSILFLFEKILQFLPERIFFRWHYQSIGSTLKKLLHTGNSIKIRCEGIRLFLLWLQALQTNCAEEQVLIFACLVPGFPAVMSSRGPCTLETLINPSPSVADVKIYPEEITPLLPAISGEKIAEDQTCFFLQILLKYMVIQAASLEWKNKENQDTGFKFLFTLFRKYYLPHLFP

SEQ ID NO: 3108 - protein, 255 aa, Homo sapiens
MSEADGLRQRRPLRPQVVTDDDGQAPEAKDGSSFSGRVFRVTFLMLAVSLTVPLLGAMMLLESPIDPQPLSFKEPPLLLGVLHPNTKLRQAERLFENQLVGPESIAHIGDVMFTGTADGRVVKLENGEIETIARFGSGPCKTRDDEPVCGRPLGIRAGPNGTLFVADAYKGLFEVNPWKREVKLLLSSETPIEGKNMSFVNDLTVTQDGRKIYFTDSSSKWQRRDYLLLVMEGTDDGRLLEYDTVTREVKVLLDQ

SEQ ID NO: 3109 - protein, 255 aa, Homo sapiens
MPKPTLLLRGGWERERSPGDSELGRQFRDWCLRTYGDSAKTKTVTRSKYQRIAEVLQGGGGTGAGSGPAAGEKGKFQFWVRSKGFRLGSGREPKMGQVVYVPVKTGSGADGLSEPEGISLKRVAVVEDFFDIIYSMHVESSAEPGKAPKHAGQKKTYRAIAETYAFLPREAVTRFLMSCTECQKRMHFNSNGLEPKENEPPSPLVSGIIDYNMPLTSTYLKQMKLRVMNSQEQDETSVSSEDFDMSDSTWMSADP

SEQ ID NO: 3110 - protein, 255 aa, Homo sapiens
MTRPEVAAERKSLVYERSGGPVRGSDLPAELTLRDPGHCCCCGSPERQEDGARKDFSSRLAAGPTFQHFLKSASAPQEKLSSEVEDPPPYLMMDELLGRQRKVYLETYGCQMNVNDTEIAWSILQKSGYLRTSNLQEADVILLVTCSIREKAEQTIWNRLHQLKALKTRRPRSRVPLRIGILGCMAERLKEEILNREKMVDILAGPDAYRDLPRLLAVAESGQQAANVLLSLDETYADVMPVQTSASATSAFVSI

SEQ ID NO: 3111 - protein, 255 aa, Homo sapiens
MSDKLPYKVADIGLAAWGRKALDIAENEMPGLMRMRERYSASKPLKGARIAGCLHMTVETAVLIETLVTLGAEVQWSSCNIFSTQDHAAAAIAKAGIPVYAWKGETDEEYLWCIEQTLYFKDGPLNMILDDGGDLTNLIHTKYPQLLPGIRGISEETTTGVHNLYKMMANGILKVPAINVNDSVTKSKFDNLYGCRESLIDGIKRATDVMIAGKVAVVAGYGDVGKGCAQALRGFGARVIITEIDPINALQAAME

SEQ ID NO: 3112 - protein, 255 aa, Homo sapiens
MAAENEASQESALGAYSPVDYMSITSFPRLPEDEPAPAAPLRGRKDEDAFLGDPDTDPDSFLKSARLQRLPSSSSEMGSQDGSPLRETRKDPFSAAAAECSCRQDGLTVIVTACLTFATGVTVALVMQIYFGDPQIFQQGAVVTDAARCTSLGIEVLSKQGSSVDAAVAAALCLGIVAPHSSGLGGGGVMLVHDIRRNESHLIDFRESAPGALREETLQRSWETKPGLLVGVPGMVKGLHEAHQLYGRLPWSQVL

SEQ ID NO: 3113 - protein, 578 aa, Homo sapiens
MPFRLLIPLGLLCALLPQHHGAPGPDGSAPDPAHYRERVKAMFYHAYDSYLENAFPFDELRPLTCDGHDTWGSFSLTLIDALDTLLILGNVSEFQRVVEVLQDSVDFDIDVNASVFETNIRVVGGLLSAHLLSKKAGVEVEAGWPCSGPLLRMAEEAARKLLPAFQTPTGMPYGTVNLLHGVNPGETPVTCTAGIGTFIVEFATLSSLTGDPVFEDVARVALMRLWESRSDIGLVGNHIDVLTGKWVAQDAGIGAGVDSYFEYLVKGAILLQDKKLMAMFLEYNKAIRNYTRFDDWYLWVQMYKGTVSMPVFQSLEAYWPGLQSLIGDIDNAMRTFLNYYTVWKQFGGLPEFYNIPQGYTVEKREGYPLRPELIESAMYLYRATGDPTLLELGRDAVESIEKISKVECGFATIKDLRDHKLDNRMESFFLAETVKYLYLLFDPTNFIHNNGSTFDAVITPYGECILGAGGYIFNTEAHPIDPAALHCCQRLKEEQWEVEDLMREFYSLKRSRSKFQKNTVSSGPWEPPARPGTLFSPENHDQARERKPAKQKVPLLSCPSQPFTSKLALLGQVFLDSS

SEQ ID NO: 3114 - protein, 530 aa, Homo sapiens
MADDIDIEAMLEAPYKKDENKLSSANGHEERSKKRKKSKSRSRSHERKRSKSKERKRSRDRERKKSKSRERKRSRSKERRRSRSRSRDRRFRGRYRSPYSGPKFNSAIRGKIGLPHSIKLSRRRSRSKSPFRKDKSPVREPIDNLTPEERDARTVFCMQLAARIRPRDLEEFFSTVGKVRDVRMISDRNSRRSKGIAYVEFVDVSSVPLAIGLTGQRVLGVPIIVQASQAEKNRAAAMANNLQKGSAGPMRLYVGSLHFNITEDMLRGIFEPFGRIESIQLMMDSETGRSKGYGFITFSDSECAKKALEQLNGFELAGRPMKVGHVTERTDASSASSFLDSDELERTGIDLGTTGRLQLMARLAEGTGLQIPPAAQQALQMSGSLAFGAVAEFSFVIDLQTRLSQQTEASALAAAASVQPLATQCFQLSNMFNPQTEEEVGWDTEIKDDVIEECNKHGGVIHIYVDKNSAQGNVYVKCPSIAAAIAAVNALHGRWFAGKMITAAYVPLPTYHNLFPDSMTATQLLVPSRR

SEQ ID NO: 3115 - protein, 87 aa, Homo sapiens
MYCLQWLLPVLLIPKPLNPALWFSHSMFMGFYLLSFLLERKPCTICALVFLAALFLICYSCWGNCFLYHCSDSPLPESAHDPGVVGT

SEQ ID NO: 3116 - protein, 255 aa, Homo sapiens
MSEESDSLRTSPSVASLSENELPPPPEPPGYVCSLTEDLVTKAREELQEKPEWRLRDVQALRDMVRKEYPNLSTSLDDAFLLRFLRARKFDYDRALQLLVNYHSCRRSWPEVFNNLKPSALKDVLASGFLTVLPHTDPRGCHVVCIRPDRWIPSNYPITENIRAIYLTLEKLIQSEETQDGFPIRIKAVHVVNEPRIFKGIFAIIKPFLKEKIANRFFLHGSDLNSLHTNLPRSILPKEYGGTAGELDTATWNAV

SEQ ID NO: 3117 - protein, 255 aa, Homo sapiens
MEENEVESSSDAAPGPGRPEEPSESGLGVGTSEAVSADSSDAAAAPGQAEADDSGVGQSSDRGSRSQEEVSESSSSADPLPNSYLPDSSSVSHGPVAGVTGGPPALVHSSALPDPNMLVSDCTASSSDLGSAIDKIIESTIGPDLIQNCITVTSAEDGGAETTRYLILQGPDDGAPMTSPMSSSTLAHSLAAIEALADGPTSTSTCLEAQGGPSSPVQLPPASGAEEPDLQSLEAMMEVVVVQQFKCKMCQYRSS

SEQ ID NO: 3118 - protein, 255 aa, Homo sapiens
MPPPSDIVKVAIEWPGANAQLLEIDQKRPLASIIKEVCDGWSLPNPEYYTLRYADGPQLYITEQTRSDIKNGTILQLAISPSRAARQLMERTQSSNMETRLDAMKELAKLSADVTFATEFINMDGIIVLTRLVESGTKLLSHYSEMLAFTLTAFLELMDHGIVSWDMVSITFIKQIAGYVSQPMVDVSILQRSLAILESMVLNSQSLYQKIAEEITVGQLISHLQVSNQEIQTYAIALINALFLKAPEDKRQDMA

SEQ ID NO: 3119 - protein, 255 aa, Homo sapiens
MRARRGLLRLPRRSLLAALFFFSLSSSLLYFVYVAPGIVNTYLFMMQAQGILIRDNVRTIGAQVYEQVLRSAYAKRNSSVNDSDYPLDLNHSETFLQTTTFLPEDFTYFANHTCPERLPSMKGPIDINMSEIGMDYIHELFSKDPTIKLGGHWKPSDCMPRWKVAILIPFRNRHEHLPVLFRHLLPMLQRQRLQFAFYVVEQVGTQPFNRAMLFNVGFQEAMKDLDWDCLIFHDVDHIPESDRNYYGCGQMPRHF

SEQ ID NO: 3120 - protein, 255 aa, Homo sapiens
MASLEVSRSPRRSRRELEVRSPRQNKYSVLLPTYNERENLPLIVWLLVKSFSESGINYEIIIIDDGSPDGTRDVAEQLEKIYGSDRILLRPREKKLGLGTAYIHGMKHATGNYIIIMDADLSHHPKFIPEFIRKQKEGNFDIVSGTRYKGNGGVYGWDLKRKIISRGANFLTQILLRPGASDLTGSFRLYRKEVLEKLIEKCVSKGYVFQMEMIVRARQLNYTIGEVPISFVDRVYGESKLGGNEIVSFLKGLLT

SEQ ID NO: 3121 - protein, 255 aa, Homo sapiens
MNASSEGESFAGSVQIPGGTTVLVELTPDIHICGICKQQFNNLDAFVAHKQSGCQLTGTSAAAPSTVQFVSEETVPATQTQTTTRTITSETQTITVSAPEFVFEHGYQTYLPTESNENQTATVISLPAKSRTKKPTTPPAQKRLNCCYPGCQFKTAYGMKDMERHLKIHTGDKPHKCEVCGKCFSRKDKLKTHMRCHTGVKPYKCKTCDYAAADSSSLNKHLRIHSDERPFKCQICPYASRNSSQLTVHLRSHTA

SEQ ID NO: 3122 - protein, 255 aa, Homo sapiens
MQSKVTGNMPTQSLLMYMDGPEVIGSSLGSPMEMEDALSMKGTAVVPFRATQEKNVIQIEGYMPLDCMFCSQTFTHSEDLNKHVLMQHRPTLCEPAVLRVEAEYLSPLDKSQVRTEPPKEKNCKENEFSCEVCGQTFRVAFDVEIHMRTHKDSFTYGCNMCGRRFKEPWFLKNHMRTHNGKSGARSKLQQGLESSPATINEVVQVHAAESISSPYKICMVCGFLFPNKESLIEHRKVHTKKTAFGTSSAQTDSPQ

SEQ ID NO: 3123 - protein, 255 aa, Homo sapiens
MARRGPGWRPLLLLVLLAGAAQGGLYFRRGQTCYRPLRGDGLAPLGRSTYPRPHEYLSPADLPKSWDWRNVDGVNYASITRNQHIPQYCGSCWAHASTSAMADRINIKRKGAWPSTLLSVQNVIDCGNAGSCEGGNDLSVWDYAHQHGIPDETCNNYQAKDQECDKFNQCGTCNEFKECHAIRNYTLWRVGDYGSLSGREKMMAEIYANGPISCGIMATERLANYTGGIYAEYQDTTYINHVVSVAGWGISDGTE

SEQ ID NO: 3124 - protein, 255 aa, Homo sapiens
MPIRPDLQQLEKCIDDALRKNDFKPLKTLLQIDICEDVKIKCSKQFFHKVDNLICRELNKEDIHNVSAILVSVGRCGKNISVLGQAGLLTMIKQGLIQKMVAWFEKSKDIIQSQGNSKDEAVLNMIEDLVDLLLVIHDVSDEGKKQVVESFVPRICSLVIDSRVNICIQQEIIKKMNAMLDKMPQDARKILSNQEMLILMSSMGERILDAGDYDLQVGIVEALCRMTTEKQRQELAHQWFSMDFIAKAFKRIKDS

SEQ ID NO: 3125 - protein, 248 aa, Homo sapiens
MSYDRAITVFSPDGHLFQVEYAQEAVKKGSTAVGVRGRDIVVLGVEKKSVAKLQDERTVRKICALDDNVCMAFAGLTADARIVINRARVECQSHRLTVEDPVTVEYITRYIASLKQRYTQSNGRRPFGISALIVGFDFDGTPRLYQTDPSGTYHAWKANAIGRGAKSVREFLEKNYTDEAIETDDLTIKLVIKALLEVVQSGGKNIELAVMRRDQSLKILNPEEIEKYVAEIEKEKEENEKKKQKKAS

SEQ ID NO: 3126 - protein, 255 aa, Homo sapiens
MDDKGDPSNEEAPKAIKPTSKEFRKTWGFRRTTIAKREGAGDAEADPLEPPPPQQQLGLSLRRSGRQPKRTERVEQFLTIARRRGRRSMPVSLEDSGEPTSCPATDAETASEGSVESASETRSGPQSASTAVKERPASSEKVKGGDDHDDTSDSDSDGLTLKELQNRLRRKREQEPTERPLKGIQSRLRKKRREEGPAETVGSEASDTVEGVLPSKQEPENDQGVVSQAGKDDRESKLEGKAAQDIKDEEPGDLG

SEQ ID NO: 3127 - protein, 255 aa, Homo sapiens
MSATSVDTQRTKGQDNKVQNGSLHQKDTVHDNDFEPYLTGQSNQSNSYPSMSDPYLSSYYPPSIGFPYSLNEAPWSTAGDPPIPYLTTYGQLSNGDHHFMHDAVFGQPGGLGNNIYQHRFNFFPENPAFSAWGTSGSQGQQTQSSAYGSSYTYPPSSLGGTVVDGQPGFHSDTLSKAPGMNSLEQGMVGLKIGDVSSSAVKTVGSVVSSVALTGVLSGNGGTNVNMPVSKPTSWAAIASKPAKPQPKMKTKSGPV

SEQ ID NO: 3128 - protein, 255 aa, Homo sapiens
MSRVVSLLLGAALLCGHGAFCRRVVSGQKVCFADFKHPCYKMAYFHELSSRVSFQEARLACESEGGVLLSLENEAEQKLIESMLQNLTKPGTGISDGDFWIGLWRNGDGQTSGACPDLYQWSDGSNSQYRNWYTDEPSCGSEKCVVMYHQPTANPGLGGPYLYQWNDDRCNMKHNYICKYEPEINPTAPVEKPYLTNQPGDTHQNVVVTEAGIIPNLIYVVIPTIPLLLLILVAFGTCCFQMLHKSKGRTKTSPN

SEQ ID NO: 3129 - protein, 255 aa, Homo sapiens
MSLSENSVFAYESSVHSTNVLLSLNDQRKKDVLCDVTIFVEGQRFRAHRSVLAACSSYFHSRIVGQADGELNITLPEEVTVKGFEPLIQFAYTAKLILSKENVDEVCKCVEFLSVHNIEESCFQFLKFKFLDSTADQQECPRKKCFSSHCQKTDLKLSLLDQRDLETDEVEEFLENKNVQTPQCKLRRYQGNAKASPPLQDSASQTYESMCLEKDAALALPSLCPKYRKFQKAFGTDRVRTGESSVKDIHASVQP

SEQ ID NO: 3130 - protein, 40 aa, Homo sapiens
MLLREITYSITPLSLHGTSLLNCNWRATGLVTLEGHRPFQ

SEQ ID NO: 3131 - protein, 255 aa, Homo sapiens
MAWSLGSWLGGCLLVSALGMVPPPENVRMNSVNFKNILQWESPAFAKGNLTFTAQYLSYRIFQDKCMNTTLTECDFSSLSKYGDHTLRVRAEFADEHSDWVNITFCPVDDTIIGPPGMQVEVLADSLHMRFLAPKIENEYETWTMKNVYNSWTYNVQYWKNGTDEKFQITPQYDFEVLRNLEPWTTYCVQVRGFLPDRNKAGEWSEPVCEQTTHDETVPSWMVAVILMASVFMVCLALLGCFALLWCVYKKTKYA

SEQ ID NO: 3132 - protein, 255 aa, Homo sapiens
MMVVLLGATTLVLVAVAPWVLSAAAGGKNLKSPQKVEVDIIDDNFILRWNRSDESVGNVTFSFDYQKTGMDNWIKLSGCQNITSTKCNFSSLKLNVYEEIKLRIRAEKENTSSWYEVDSFTPFRKAQIGPPEVHLEAEDKAIVIHISPGTKDSVMWALDGLSFTYSLVIWKNSSGVEERIENIYSRHKIYKLSPETTYCLKVKAALLTSWKIGVYSPVHCIKTTVENELPPPENIEVSVQNQNYVLKWDYTYANM

SEQ ID NO: 3133 - protein, 337 aa, Homo sapiens
MRPTLLWSLLLLLGVFAAAAAAPPDPLSQLPAPQHPKIRLYNAEQVLSWEPVALSNSTRPVVYQVQFKYTDSKWFTADIMSIGVNCTQITATECDFTAASPSAGFPMDFNVTLRLRAELGALHSAWVTMPWFQHYRNVTVGPPENIEVTPGEGSLIIRFSSPFDIADTSTAFFCYYVHYWEKGGIQQVKGPFRSNSISLDNLKPSRVYCLQVQAQLLWNKSNIFRVGHLSNISCYETMADASTELQQVILISVGTFSLLSVLAGACFFLVLKYRGLIKYWFHTPPSIPLQIEEYLKDPTQPILEALDKDSSPKDDVWDSVSIISFPEKEQEDVLQTL

SEQ ID NO: 3134 - protein, 255 aa, Homo sapiens
MATNIEQIFRSFVVSKFREIQQELSSGRNEGQLNGETNTPIEGNQAGDAAASARSLPNEEIVQKIEEVLSGVLDTELRYKPDLKEGSRKSRCVSVQTDPTDEIPTKKSKKHKKHKNKKKKKKKEKEKKYKRQPEESESKTKSHDDGNIDLESDSFLKFDSEPSAVALELPTRAFGPSETNESPAVVLEPPVVSMEVSEPHILETLKPATKTAELSVVSTSVISEQSEQSVAVMPEPSMTKILDSFAAAPVPTTTL

SEQ ID NO: 3135 - protein, 255 aa, Homo sapiens
MAAQPPRGIRLSALCPKFLHTNSTSHTWPFSAVAELIDNAYDPDVNAKQIWIDKTVINDHICLTFTDNGNGMTSDKLHKMLSFGFSDKVTMNGHVPVGLYGNGFKSGSMRLGKDAIVFTKNGESMSVGLLSQTYLEVIKAEHVVVPIVAFNKHRQMINLAESKASLAAILEHSLFSTEQKLLAELDAIIGKKGTRIIIWNLRSYKNATEFDFEKDKYDIRIPEDLDEITGKKGYKKQERMDQIAPESDYSLRAYC

SEQ ID NO: 3136 - protein, 255 aa, Homo sapiens
MHTGGETSACKPSSVRLAPSFSFHAAGLQMAGQMPHSHQYSDRRQPNISDQQVSALSYSDQIQQPLTNQVMPDIVMLQRRMPQTFRDPATAPLRKLSVDLIKTYKHINEVYYAKKKRRHQQGQGDDSSHKKERKVYNDGYDDDNYDYIVKNGEKWMDRYEIDSLIGKGSFGQVVKAYDRVEQEWVAIKIIKNKKAFLNQAQIEVRLLELMNKHDTEMKYYIVHLKRHFMFRNHLCLVFEMLSYNLYDLLRNTNFR

SEQ ID NO: 3137 - protein, 255 aa, Homo sapiens
MDAIHIGMSSTPLVKHTAGAGLKANRPRVMSKSGHSNVRIDKVDGIYLLYLQDLWTTVIDMKWRYKLTLFAATFVMTWFLFGVIYYAIAFIHGDLEPGEPISNHTPCIMKVDSLTGAFLFSLESQTTIGYGVRSITEECPHAIFLLVAQLVITTLIEIFITGTFLAKIARPKKRAETIKFSHCAVITKQNGKLCLVIQVANMRKSLLIQCQLSGKLLQTHVTKEGERILLNQATVKFHVDSSSESPFLILPMTFY

SEQ ID NO: 3138 - protein, 255 aa, Homo sapiens
MGSAQFQGLITQARLPFGATSTTAPSLRNSKGRFGVRALAPERTPSAPRKVSARLPGRTLARTWGRGPAPGASGPAGEGPSRVTAGGGGKLRAPGAARPASGLPDRLWPAPSPSPGAHRAAAGAEQPPSRPSAGPARSGRMNDFGIKNMDQVAPVANSYRGTLKRQPAFDTFDGSLFAVFPSLNEEQTLQEVPTGLDSISHDSANCELPLLTPCSKAVMSQALKATFSGFKKEQRRLGIPKNPWLWSEQQVCQWL

SEQ ID NO: 3139 - protein, 255 aa, Homo sapiens
MAPAMQPAEIQFAQRLASSEKGIRDRAVKKLRQYISVKTQRETGGFSQEELLKIWKGLFYCMWVQDEPLLQEELANTIAQLVHAVNNSAAQHLFIQTFWQTMNREWKGIDRLRLDKYYMLIRLVLRQSFEVLKRNGWEESRIKVFLDVLMKEVLCPESQSPNGVRFHFIDIYLDELSKVGGKELLADQNLKFIDPFCKIAAKTKDHTLVQTIARGVFEAIVDQSPFVPEETMEEQKTKVGDGDLSAEEIPENEVS

SEQ ID NO: 3140 - protein, 780 aa, Homo sapiens
MAAVDLEKLRASGAGKAIGVLTSGGDAQGMNAAVRAVTRMGIYVGAKVFLIYEGYEGLVEGGENIKQANWLSVSNIIQLGGTIIGSARCKAFTTREGRRAAAYNLVQHGITNLCVIGGDGSLTGANIFRSEWGSLLEELVAEGKISETTARTYSHLNIAGLVGSIDNDFCGTDMTIGTDSALHRIMEVIDAITTTAQSHQRTFVLEVMGRHCGYLALVSALASGADWLFIPEAPPEDGWENFMCERLGETRSRGSRLNIIIIAEGAIDRNGKPISSSYVKDLVVQRLGFDTRVTVLGHVQRGGTPSAFDRILSSKMGMEAVMALLEATPDTPACVVTLSGNQSVRLPLMECVQMTKEVQKAMDDKRFDEATQLRGGSFENNWNIYKLLAHQKPPKEKSNFSLAILNVGAPAAGMNAAVRSAVRTGISHGHTVYVVHDGFEGLAKGQVQEVGWHDVAGWLGRGGSMLGTKRTLPKGQLESIVENIRIYGIHALLVVGGFEAYEGVLQLVEARGRYEELCIVMCVIPATISNNVPGTDFSLGSDTAVNAAMESCDRIKQSASGTKRRVFIVETMGGYCGYLATVTGIAVGADAAYVFEDPFNIHDLKVNVEHMTEKMKTDIQRGLVLRNEKCHDYYTTEFLYNLYSSEGKGVFDCRTNVLGHLQQGGAPTPFDRNYGTKLGVKAMLWLSEKLREVYRKGRVFANAPDSACVIGLKKKAVAFSPVTELKKDTDFEHRMPREQWWLSLRLMLKMLAQYRISMAAYVSGELEHVTRRTLSMDKGF

SEQ ID NO: 3141 - protein, 1553 aa, Homo sapiens
MEPSALRKAGSEQEEGFEGLPRRVTDLGMVSNLRRSNSSLFKSWRLQCPFGNNDKQESLSSWIPENIKKKECVYFVESSKLSDAGKVVCQCGYTHEQHLEEATKPHTFQGTQWDPKKHVQEMPTDAFGDIVFTGLSQKVKKYVRVSQDTPSSVIYHLMTQHWGLDVPNLLISVTGGAKNFNMKPRLKSIFRRGLVKVAQTTGAWIITGGSHTGVMKQVGEAVRDFSLSSSYKEGELITIGVATWGTVHRREGLIHPTGSFPAEYILDEDGQGNLTCLDSNHSHFILVDDGTHGQYGVEIPLRTRLEKFISEQTKERGGVAIKIPIVCVVLEGGPGTLHTIDNATTNGTPCVVVEGSGRVADVIAQVANLPVSDITISLIQQKLSVFFQEMFETFTESRIVEWTKKIQDIVRRRQLLTVFREGKDGQQDVDVAILQALLKASRSQDHFGHENWDHQLKLAVAWNRVDIARSEIFMDEWQWKPSDLHPTMTAALISNKPEFVKLFLENGVQLKEFVTWDTLLYLYENLDPSCLFHSKLQKVLVEDPERPACAPAAPRLQMHHVAQVLRELLGDFTQPLYPRPRHNDRLRLLLPVPHVKLNVQGVSLRSLYKRSSGHVTFTMDPIRDLLIWAIVQNRRELAGIIWAQSQDCIAAALACSKILKELSKEEEDTDSSEEMLALAEEYEHRAIGVFTECYRKDEERAQKLLTRVSEAWGKTTCLQLALEAKDMKFVSHGGIQAFLTKVWWGQLSVDNGLWRVTLCMLAFPLLLTGLISFREKRLQDVGTPAARARAFFTAPVVVFHLNILSYFAFLCLFAYVLMVDFQPVPSWCECAIYLWLFSLVCEEMRQLFYDPDECGLMKKAALYFSDFWNKLDVGAILLFVAGLTCRLIPATLYPGRVILSLDFILFCLRLMHIFTISKTLGPKIIIVKRMMKDVFFFLFLLAVWVVSFGVAKQAILIHNERRVDWLFRGAVYHSYLTIFGQIPGYIDGVNFNPEHCSPNGTDPYKPKCPESDATQQRPAFPEWLTVLLLCLYLLFTNILLLNLLIAMFNYTFQQVQEHTDQIWKFQRHDLIEEYHGRPAAPPPFILLSHLQLFIKRVVLKTPAKRHKQLKNKLEKNEEAALLSWEIYLKENYLQNRQFQQKQRPEQKIEDISNKAGLELWGSRTSSVCKSRQFLHLTVVESRGSEKAPVTTLACLQGCLGKHGRVDAMVDLLDLDPLKRSGSMEQRLASLEEQVAQTARALHWIVRTLRASGFSSEADVPTLASQKAAEEPDAEPGGRKKTEEPGDSYHVNARHLLYPNCPVTRFPVPNEKVPWETEFLIYDPPFYTAERKDAAAMDPMGDTLEPLSTIQYNVVDGLRDRRSFHGPYTVQAGLPLNPMGRTGLRGRGSLSCFGPNHTLYPMVTRWRRNEDGAICRKSIKKMLEVLVVKLPLSEHWALPGGSREPGEMLPRKLKRILRQEHWPSFENLLKCGMEVYKGYMDDPRNTDNAWIETVAVSVHFQDQNDVELNRLNSNLHACDSGASIRWQVVDRRIPLYANHKTLLQKAAAEFGAHY

SEQ ID NO: 3142 - protein, 255 aa, Homo sapiens
MDIEDEENMSSSSTDVKENRNLDNVSPKDGSTPGPGEGSQLSNGGGGGPGRKRPLEEGSNGHSKYRLKKRRKTPGPVLPKNALMQLNEIKPGLQYTLLSQTGPVHAPLFVMSVEVNGQVFEGSGPTKKKAKLHAAEKALRSFVQFPNASEAHLAMGRTLSVNTDFTSDQADFPDTLFNGFETPDKAEPPFYVGSNGDDSFSSSGDLSLSASPVPASLAQPPLPVLPPFPPPSGKNPVMILNELRPGLKYDFLSES

SEQ ID NO: 3143 - protein, 255 aa, Homo sapiens
MEIRLDTLSASLGRSSTLNNCNLEDKLAWYEGEAYMWHHWKPFPENPLWTCLDFQIAQVGPWDHCSSCIRHTRLKSSCSDMDLLHSWRSSSFGNFDRFRNNSLSKPDDSTEAHEGDPTNGSGEQSKTSNNGGGLGKKMRAISWTMKKKVGKKYIKALSEEKDEEDGENAHPYRNSDPVIGTHTEKVSLKASDSMDSLYSGQSSSSGITSCSDGTSNRDSFRLDDDGPYSGPFCGRARVHTDFTPSPYDTDSLKIK

SEQ ID NO: 3144 - protein, 214 aa, Homo sapiens
MAGENFATPFHGHVGRGAFSDVYEPAEDTFLLLNALEAAAAELAGVEICLEVGSGSGVVSAFLASMIGPQALYMCTDINPEAAACTLETARCNKVHIQPVITDLVKGLLPRLTEKVDLLVFNPPYVVTPPQEVGSHGIEAAWAGGRNGREVMDRFFPLVPDLLSPRGLFYLVTIKENNPEEILKIMKTKGLQGTTALSRQAGQETLSVLKFTKS

SEQ ID NO: 3145 - protein, 255 aa, Homo sapiens
MRKRWACWSGSDAPGGCGGGCGRRRRRSRRKRAASEERRMAFSKGFRIYHKLDPPPFSLIVETRHKEECLMFESGAVAVLSSAEKEAIKGTYSKVLDAYGLLGVLRLNLGDTMLHYLVLVTGCMSVGKIQESEVFRVTSTEFISLRIDSSDEDRISEVRKVLNSGNFYFAWSASGISLDLSLNAHRSMQEQTTDNRFFWNQSLHLHLKHYGVNCDDWLLRLMCGGVEIRTIYAAHKQAKACLISRLSCERAGTRF

SEQ ID NO: 3146 - protein, 158 aa, Homo sapiens
MAGFLDNFRWPECECIDWSERRNAVASVVAGILFFTGWWIMIDAAVVYPKPEQLNHAFHTCGVFSTLAFFMINAVSNAQVRGDSYESGCLGRTGARVWLFIGFMLMFGSLIASMWILFGAYVTQNTDVYPGLAVFFQNALIFFSTLIYKFGRTEELWT

SEQ ID NO: 3147 - protein, 129 aa, Homo sapiens
MILSNTTAVTPFLTKLWQETVQQGGNMSGLARRSPRSSDGKLEALYVLMVLGFFGFFTLGIMLSYIRSKKLEHSNDPFNVYIESDAWQEKDKAYVQARVLESYRSCYVVENHLAIEQPNTHLPETKPSP

SEQ ID NO: 3148 - protein, 255 aa, Homo sapiens
MPRRRPPASGAAQFPERIATRSPDPIPLCTFQRQVSEMAEDGSEEIMFIWCEDCSQYHDSECPELGPVVMVKDSFVLSRARSSLPPNLEIRRLEDGAEGVFAITQLVKRTQFGPFESRRVAKWEKESAFPLKVFQKDGHPVCFDTSNEDDCNWMMLVRPAAEAEHQNLTAYQHGSDVYFTTSRDIPPGTELRVWYAAFYAKKMDKPMLKQAGSGVHAAGTPENSAPVESEPSQWACKVCSATFLELQLLNEHLLG

SEQ ID NO: 3149 - protein, 255 aa, Homo sapiens
MAMARLGSWLGEAQWLALVSLFVAALATVGLYLAQWALARARPQPQRRAVEPGEGPRPGSDALLSWILTLGSWRSQWQAAWVTALNEEAERKGGPPFLSFEEDPRQQALELVVQEVSSVLRSAEEKVVVCHVVGQAIQFLVSETPALGAGCRLYDMRLSPFHLQLEFHMKEKREDLQISWSFISVPEMAVNIQPKALGEDQVAETSAMSDVLKDILKHLAGSASPSVVLITKPTTVKEAQNLQCAASTAQESCPP

SEQ ID NO: 3150 - protein, 255 aa, Homo sapiens
MAGSVGLALCGQTLVVRGGSRFLATSIASSDDDSLFIYDCSAAEKKSQENKGEDAPLDQGSGAILASTFSKSGSYFALTDDSKRLILFRTKPWQCLSVRTVARRCTALTFIASEEKVLVADKSGDVYSFSVLEPHGCGRLELGHLSMLLDVAVSPDDRFILTADRDEKIRVSWAAAPHSIESFCLGHTEFVSRISVVPTQPGLLLSSSGDGTLRLWEYRSGRQLHCCHLASLQELVDPQAPQKFAASRIAFWCQE

SEQ ID NO: 3151 - protein, 167 aa, Homo sapiens
MQEHYDEFFEEVFTEMEEKYGEVEEMNVCDNLGDHLVGNVYVKFRREEDAEKAVIDLNNRWFNGQPIHAELSPVTDFREACCRQYEMGECTRGGFCNFMHLKPISRELRRELYGRRRKKHRSRSRSRERRSRSRDRGRGGGGGGGGGGGGRERDRRRSRDRERSGRF

SEQ ID NO: 3152 - protein, 98 aa, Homo sapiens
MMCGAPSATQPATAETQHIADQVRSQLEEKENKKFPVFKAVSFKSQVVAGTNYFIKVHVGDEDFVHLRVFQSLPHENKPLTLSNYQTNKAKHDELTYF

SEQ ID NO: 3153 - protein, 137 aa, Homo sapiens
MNEENFFEWEALIMGPEDTCFEFGVFPAILSFPLDYPLSPPKMRFTCEMFHPNIYPDGRVCISILHAPGDDPMGYESSAERWSPVQSVEKILLSVVSMLAEPNDESGANVDASKMWRDDREQFYKIAKQIVQKSLGL

SEQ ID NO: 3154 - protein, 180 aa, Homo sapiens
MAPGVARGPTPYWRLRLGGAALLLLLIPVAAAQEPPGAACSQNTNKTCEECLKNVSCLWCNTNKACLDYPVTSVLPPASLCKLSSARWGVCWVNFEALIITMSVVGGTLLLGIAICCCCCCRRKRSRKPDRSEEKAMREREERRIRQEERRAEMKTRHDEIRKKYGLFKEENPYARFENN

SEQ ID NO: 3155 - protein, 255 aa, Homo sapiens
MATLSFVFLLLGAVSWPPASASGQEFWPGQSAADILSGAASRRRYLLYDVNPPEGFNLRRDVYIRIASLLKTLLKTEEWVLVLPPWGRLYHWQSPDIHQVRIPWSEFFDLPSLNKNIPVIEYEQFIAESGGPFIDQVYVLQSYAEGWKEGTWEEKVDERPCIDQLLYSQDKHEYYRGWFWGYEETRGLNVSCLSVQGSASIVAPLLLRNTSARSVMLDRAENLLHDHYGGKEYWDTRRSMVFARHLREVGDEFRS

SEQ ID NO: 3156 - protein, 255 aa, Homo sapiens
MNPTNPFSGQQPSAFSASSSNVGTLPSKPPFRFGQPSLFGQNSTLSGKSSGFSQVSSFPASSGVSHSSSVQTLGFTQTSSVGPFSGLEHTSTFVATSGPSSSSVLGNTGFSFKSPTSVGAFPSTSAFGQEAGEIVNSGFGKTEFSFKPLENAVFKPILGAESEPEKTQSQIASGFFTFSHPISSAPGGLAPFSFPQVTSSSATTSNFTFSKPVSSNNSLSAFTPALSNQNVEEEKRGPKSIFGSSNNSFSSFPVS

SEQ ID NO: 3157 - protein, 255 aa, Homo sapiens
MGAARSPPSAVPGPLLGLLLLLLGVLAPGGASLRLLDHRALVCSQPGLNCTVKNSTCLDDSWIHPRNLTPSSPKDLQIQLHFAHTQQGDLFPVAHIEWTLQTDASILYLEGAELSVLQLNTNERLCVRFEFLSKLRHHHRRWRFTFSHFVVDPDQEYEVTVHHLPKPIPDGDPNHQSKNFLVPDCEHARMKVTTPCMSSGSLWDPNITVETLEAHQLRVSFTLWNESTHYQILLTSFPHMENHSCFEHMHHIPAP

SEQ ID NO: 3158 - protein, 170 aa, Homo sapiens
MALLLSDWCPDGDADTHTGTDPGRTTHRLCARERGVRGTQPCPRIYLRLPAQNCEETRFCCASPGSVVLGHGAPRTASPPSALSHPSPLEGLSFSPFPPSVLSHPSPPEGLSFSLFHCLCSGKLSESPGCFWNSLGWSFSVLTEPGVWKVGEAIWVAENLAQPLTSPCAC

SEQ ID NO: 3159 - protein, 255 aa, Homo sapiens
MAGPGSTGGQIGAAALAGGARSKVAPSVDFDHSCSDSVEYLTLNFGPFETVHRWRRLPPCDEFVGARRSKHTVVAYKDAIYVFGGDNGKTMLNDLLRFDVKDCSWCRAFTTGTPPAPRYHHSAVVYGSSMFVFGGYTGDIYSNSNLKNKNDLFEYKFATGQWTEWKIEGRLPVARSAHGATVYSDKLWIFAGYDGNARLNDMWTIGLQDRELTCWEEVAQSGEIPPSCCNFPVAVCRDKMFVFSGQSGAKITNNL

SEQ ID NO: 3160 - protein, 255 aa, Homo sapiens
MGKRQHQKDKMYITCAEYTHFYGGKKPDLPQTNFRRLPFDHCSLSLQPFVYPVCTPDGIVFDLLNIVPWLKKYGTNPSNGEKLDGRSLIKLNFSKNSEGKYHCPVLFTVFTNNTHIVAVRTTGNVYAYEAVEQLNIKAKNFRDLLTDEPFSRQDIITLQDPTNLDKFNVSNFYHVKNNMKIIDPDEEKAKQDPSYYLKNTNAETRETLQELYKEFKGDEILAATMKAPEKKKVDKLNAAHYSTGKVSASFTSTAM

SEQ ID NO: 3161 - protein, 255 aa, Homo sapiens
MKKASRSVGSVPKVSAISKTQTAEKIKPENSSSASTGGKLVKPGTAASLSKTKSSDDLLAGMAGGVTVTNGVKGKKSTCPSAAPSASAPAMTTVENKSKISTGTASSTKRSTSTGNKESSSTRERLRERTRLNQSKKLPSAGQGANDMALAKRSRSRTATECDVRMSKSKSDNQISDRAALEAKVKDLLTLAKTKDVEILHLRNELRDMRAQLGINEDHSEGDEKSEKETIMAHQPTDVESTLLQLQEQNTAIRE

SEQ ID NO: 3162 - protein, 126 aa, Homo sapiens
MSIGVPIKVLHEAEGHIVTCETNTGEVYRGKLIEAEDNMNCQMSNITVTYRDGRVAQLEQVYIRGSKIRFLILPDMLKNAPMLKSMKNKNQGSGAGRGKAAILKAQVAARGRGRGMGRGNIFQKRR

SEQ ID NO: 3163 - protein, 255 aa, Homo sapiens
MAGAIASRMSFSSLKRKQPKTFTVRIVTMDAEMEFNCEMKWKGKDLFDLVCRTLGLRETWFFGLQYTIKDTVAWLKMDKKVLDHDVSKEEPVTFHFLAKFYPENAEEELVQEITQHLFFLQVKKQILDEKIYCPPEASVLLASYAVQAKYGDYDPSVHKRGFLAQEELLPKRVINLYQMTPEMWEERITAWYAEHRGRARDEAEMEYLKIAQDLEMYGVNYFAIRNKKGTELLLGVDALGLHIYDPENRLTPKIS

SEQ ID NO: 3164 - protein, 255 aa, Homo sapiens
MGSYLSVPAYFTSRDLFRCSECQDSLTNWYYEKDGKLYCPKDYWGKFGEFCHGCSLLMTGPFMVAGEFKYHPECFACMSCKVIIEDGDAYALVQHATLYCGKCHNEVVLAPMFERLSTESVQEQLPYSVTLISMPATTEGRRGFSVSVESACSNYATTVQVKEVNRMHISPNNRNAIHPGDRILEINGTPVRTLRVEEVEDAISQTSQTLQLLIEHDPVSQRLDQLRLEARLAPHMQNAGHPHALSTLDTKENLE

SEQ ID NO: 3165 - protein, 255 aa, Homo sapiens
MDSSTWSPKTTAVTRPVETHELIRNAADISIIVIYFVVVMAVGLWAMFSTNRGTVGGFFLAGRSMVWWPIGASLFASNIGSGHFVGLAGTGAASGIAIGGFEWNALVLVVVLGWLFVPIYIKAGVVTMPEYLRKRFGGQRIQVYLSLLSLLLYIFTKISADIFSGAIFINLALGLNLYLAIFLLLAITALYTITGGLAAVIYTDTLQTVIMLVGSLILTGFAFHEVGGYDAFMEKYMKAIPTIVSDGNTTFQEKC

SEQ ID NO: 3166 - protein, 255 aa, Homo sapiens
MSGFDDPGIFYSDSFGGDAQADEGQARKSQLQRRFKEFLRQYRVGTDRTGFTFKYRDELKRHYNLGEYWIEVEMEDLASFDEDLADYLYKQPAEHLQLLEEAAKEVADEVTRPRPSGEEVLQDIQVMLKSDASPSSIRSLKSDMMSHLVKIPGIIIAASAVRAKATRISIQCRSCRNTLTNIAMRPGLEGYALPRKCNTDQAGRPKCPLDPYFIMPDKCKCVDFQTLKLQELPDAVPHGEMPRHMQLYCDRYLCD

SEQ ID NO: 3167 - protein, 255 aa, Homo sapiens
MAVAQQLRAESDFEQLPDDVAISANIADIEEKRGFTSHFVFVIEVKTKGGSKYLIYRRYRQFHALQSKLEERFGPDSKSSALACTLPTLPAKVYVGVKQEIAEMRIPALNAYMKSLLSLPVWVLMDEDVRIFFYQSPYDSEQVPQALRRLRPRTRKVKSVSPQGNSVDRMAAPRAEALFDFTGNSKLELNFKAGDVIFLLSRINKDWLEGTVRGATGIFPLSFVKILKDFPEEDDPTNWLRCYYYEDTISTIKSV

SEQ ID NO: 3168 - protein, 255 aa, Homo sapiens
MKSCGKRFHDEVGKFRFLNELIKVVSPKYLGSRTSEKVKNKILELLYSWTVGLPEEVKIAEAYQMLKKQGIVKSDPKLPDDTTFPLPPPRPKNVIFEDEEKSKMLARLLKSSHPEDLRAANKLIKEMVQEDQKRMEKISKRVNAIEEVNNNVKLLTEMVMSHSQGGAAAGSSEDLMKELYQRCERMRPTLFRLASDTEDNDEALAEILQANDNLTQVINLYKQLVRGEEVNGDATAGSIPGSTSALLDLSGLDLP

SEQ ID NO: 3169 - protein, 255 aa, Homo sapiens
MMKRQLHRMRQLAQTGSLGRTPETAEFLGEDLLQVEQRLEPAKRAAHNIHKRLQACLQGQSGADMDKRVKKLPLMALSTTMAESFKELDPDSSMGKALEMSCAIQNQLARILAEFEMTLERDVLQPLSRLSEEELPAILKHKKSLQKLVSDWNTLKSRLSQATKNSGSSQGLGGSPGSHSHTTMANKVETLKEEEEELKRKVEQCRDEYLADLYHFVTKEDSYANYFIRLLEIQADYHRRSLSSLDTALAELREN

SEQ ID NO: 3170 - protein, 127 aa, Homo sapiens
MSDNEDNFDGDDFDDVEEDEGLDDLENAEEEGQENVEILPSGERPQANQKRITTPYMTKYERARVLGTRALQIAMCAPVMVELEGETDPLLIAMKELKARKIPIIIRRYLPDGSYEDWGVDELIITD

SEQ ID NO: 3171 - protein, 199 aa, Homo sapiens
MEASPASGPRHLMDPHIFTSNFNNGIGRHKTYLCYEVERLDNGTSVKMDQHRGFLHNQAKNLLCGFYGRHAELRFLDLVPSLQLDPAQIYRVTWFISWSPCFSWGCAGEVRAFLQENTHVRLRIFAARIYDYDPLYKEALQMLRDAGAQVSIMTYDEFKHCWDTFVDHQGCPFQPWDGLDEHSQALSGRLRAILQNQGN

SEQ ID NO: 3172 - protein, 255 aa, Homo sapiens
MNPQIRNPMERMYRDTFYDNFENEPILYGRSYTWLCYEVKIKRGRSNLLWDTGVFRGPVLPKRQSNHRQEVYFRFENHAEMCFLSWFCGNRLPANRRFQITWFVSWNPCLPCVVKVTKFLAEHPNVTLTISAARLYYYRDRDWRWVLLRLHKAGARVKIMDYEDFAYCWENFVCNEGQPFMPWYKFDDNYASLHRTLKEILRNPMEAMYPHIFYFHFKNLLKACGRNESWLCFTMEVTKHHSAVFRKRGVFRNQV

SEQ ID NO: 3173 - protein, 255 aa, Homo sapiens
MTEMSFLSSEVLVGDLMSPFDQSGLGAEESLGLLDDYLEVAKHFKPHGFSSDKAKAGSSEWLAVDGLVSPSNNSKEDAFSGTDWMLEKMDLKEFDLDALLGIDDLETMPDDLLTTLDDTCDLFAPLVQETNKQPPQTVNPIGHLPESLTKPDQVAPFTFLQPLPLSPGVLSSTPDHSFSLELGSEVDITEGDRKPDYTAYVAMIPQCIKEEDTPSDNDSGICMSPESYLGSPQHSPSTRGSPNRSLPSPGVLCGS

SEQ ID NO: 3174 - protein, 255 aa, Homo sapiens
MAESASPPSSSAAAPAAEPGVTTEQPGPRSPPSSPPGLEEPLDGADPHVPHPDLAPIAFFCLRQTTSPRNWCIKMVCNPWFECVSMLVILLNCVTLGMYQPCDDMDCLSDRCKILQVFDDFIFIFFAMEMVLKMVALGIFGKKCYLGDTWNRLDFFIVMAGMVEYSLDLQNINLSAIRTVRVLRPLKAINRVPSMRILVNLLLDTLPMLGNVLLLCFFVFFIFGIIGVQLWAGLLRNRCFLEENFTIQGDVALPP

SEQ ID NO: 3175 - protein, 255 aa, Homo sapiens
MERQKRKADIEKGLQFIQSTLPLKQEEYEAFLLKLVQNLFAEGNDLFREKDYKQALVQYMEGLNVADYAASDQVALPRELLCKLHVNRAACYFTMGLYEKALEDSEKALGLDSESIRALFRKARALNELGRHKEAYECSSRCSLALPHDESVTQLGQELAQKLGLRVRKAYKRPQELETFSLLSNGTAAGVADQGTSNGLGSIDDIETDCYVDPRGSPALLPSTPTMPLFPHVLDLLAPLDSSRTLPSTDSLDDF

SEQ ID NO: 3176 - protein, 229 aa, Homo sapiens
MDLLQFLAFLFVLLLSGMGATGTLRTSLDPSLEIYKKMFEVKRREQLLALKNLAQLNDIHQQYKILDVMLKGLFKVLEDSRTVLTAADVLPDGPFPQDEKLKDAFSHVVENTAFFGDVVLRFPRIVHYYFDHNSNWNLLIRWGISFCNQTGVFNQGPHSPILSLMAQELGISEKDSNFQNPFKIDRTEFIPSTDPFQKALREEEKRRKKEEKRKEIRKGPRISRSQSEL

SEQ ID NO: 3177 - protein, 169 aa, Homo sapiens
MAPPWVPAMGFTLAPSLGCFVGSRFVHGEGLRWYAGLQKPSWHPPHWVLGPVWGTLYSAMGYGSYLVWKELGGFTEKAVVPLGLYTGQLALNWAWPPIFFGARQMGWALVDLLLVSGAAAATTVAWYQVSPLAARLLYPYLAWLAFTTTLNYCVWRDNHGWRGGRRLPE

SEQ ID NO: 3178 - protein, 255 aa, Homo sapiens
MAKRNAEKELTDRNWDQEDEAEEVGTFSMASEEVLKNRAIKKAKRRNVGFESDTGGAFKGFKGLVVPSGGGRFSGFGSGAGGKPLEGLSNGNNITSAPPFASAKAAADPKVAFGSLAANGPTTLVDKVSNPKTNGDSQQPSSSGLASSKACVGNAYHKQLAALNCSVRDWIVKHVNTNPLCDLTPIFKDYEKYLANIEQQHGNSGRNSESESNKVAAETQSPSLFGSTKLQQESTFLFHGNKTEDTPDKKMEVAS

SEQ ID NO: 3179 - protein, 255 aa, Homo sapiens
MASDGARKQFWKRSNSKLPGSIQHVYGAQHPPFDPLLHGTLLRSTAKMPTTPVKAKRVSTFQEFESNTSDAWDAGEDDDELLAMAAESLNSEVVMETANRVLRNHSQRQGRPTLQEGPGLQQKPRPEAEPPSPPSGDLRLVKSVSESHTSCPAESASDAAPLQRSQSLPHSATVTLGGTSDPSTLSSSALSEREASRLDKFKQLLAGPNTDLEELRRLSWSGIPKPVRPMTWKLLSGYLPANVDRRPATLQRKQK

SEQ ID NO: 3180 - protein, 255 aa, Homo sapiens
MAVYRAALGASLAAARLLPLGRCSPSPAPRSTLSGAAMEPAPRWLAGLRFDNRALRALPVEAPPPGPEGAPSAPRPVPGACFTRVQPTPLRQPRLVALSEPALALLGLGAPPAREAEAEAALFFSGNALLPGAEPAAHCYCGHQFGQFAGQLGDGAAMYLGEVCTATGERWELQLKGAGPTPFSRQADGRKVLRSSIREFLCSEAMFHLGVPTTRAGACVTSESTVVRDVFYDGNPKYEQCTVVLRVASTFIRFG

SEQ ID NO: 3181 - protein, 255 aa, Homo sapiens
MFWKFDLNTTSHVDKLLDKEHVTLQELMDEDDILQECKAQNQKLLDFLCRQQCMEELVSLITQDPPLDMEEKVRFKYPNTACELLTCDVPQISDRLGGDESLLSLLYDFLDHEPPLNPLLASFFSKTIGNLIARKTEQVITFLKKKDKFISLVLKHIGTSALMDLLLRLVSCVEPAGLRQDVLHWLNEEKVIQRLVELIHPSQDEDRQSNASQTLCDIVRLGRDQGSQLQEALEPDPLLTALESQDCVEQLLKNM

SEQ ID NO: 3182 - protein, 255 aa, Homo sapiens
MEDVEARFAHLLQPIRDLTKNWEVDVAAQLGEYLEELDQICISFDEGKTTMNFIEAALLIQGSACVYSKKVEYLYSLVYQALDFISGKRRAKQLSSVQEDRANGVASSGVPQEAENEFLSLDDFPDSRTNVDLKNDQTPSEVLIIPLLPMALVAPDEMEKNNNPLYSRQGEVLASRKDFRMNTCVPHPRGAFMLEPEGMSPMEPAGVSPMPGTQKDTGRTEEQPMEVSVCRSPVPALGFSQEPGPSPEGPMPLGG

SEQ ID NO: 3183 - protein, 241 aa, Homo sapiens
MCSGAGVMMARWAARGRAGWRSTVRILSPLGHCEPGVSRSCRAAQAMDCEVNNGSSLRDECITNLLVFGFLQSCSDNSFRRELDALGHELPVLAPQWEGYDELQTDGNRSSHSRLGRIEADSESQEDIIRNIARHLAQVGDSMDRSIPPGLVNGLALQLRNTSRSEEDRNRDLATALEQLLQAYPRDMEKEKTMLVLALLLAKKVASHTPSLLRDVFHTTVNFINQNLRTYVRSLARNGMD

SEQ ID NO: 3184 - protein, 255 aa, Homo sapiens
MPAPRAPRALAAAAPASGKAKLTHPGKAILAGGLAGGIEICITFPTEYVKTQLQLDERSHPPRYRGIGDCVRQTVRSHGVLGLYRGLSSLLYGSIPKAAVRFGMFEFLSNHMRDAQGRLDSTRGLLCGLGAGVAEAVVVVCPMETIKVKFIHDQTSPNPKYRGFFHGVREIVREQGLKGTYQGLTATVLKQGSNQAIRFFVMTSLRNWYRGDNPNKPMNPLITGVFGAIAGAASVFGNTPLDVIKTRMQGLEAHK

SEQ ID NO: 3185 - protein, 255 aa, Homo sapiens
MAEEQEFTQLCKLPAQPSHPHCVNNTYRSAQHSQALLRGLLALRDSGILFDVVLVVEGRHIEAHRILLAASCDYFRGMFAGGLKEMEQEEVLIHGVSYNAMCQILHFIYTSELELSLSNVQETLVAACQLQIPEIIHFCCDFLMSWVDEENILDVYRLAELFDLSRLTEQLDTYILKNFVAFSRTDKYRQLPLEKVYSLLSSNRLEVSCETEVYEGALLYHYSLEQVQADQISLHEPPKLLETVRFPLMEAEVLQ

SEQ ID NO: 3186 - protein, 255 aa, Homo sapiens
MAAAPARGGGGGGGGGGGCSGSGSSASRGFYFNTVLSLARSLAVQRPASLEKVQKLLCMCPVDFHGIFQLDERRRDAVIALGIFLIESDLQHKDCVVPYLLRLLKGLPKVYWVEESTARKGRGALPVAESFSFCLVTLLSDVAYRDPSLRDEILEVLLQVLHVLLGMCQALEIQDKEYLCKYAIPCLIGISRAFGRYSNMEESLLSKLFPKIPPHSLRVLEELEGVRRRSFNDFRSILPSNLLTVCQEGTLKRKT

SEQ ID NO: 3187 - protein, 255 aa, Homo sapiens
MAAAAAAGAGPEMVRGQVFDVGPRYTNLSYIGEGAYGMVCSAYDNVNKVRVAIKKISPFEHQTYCQRTLREIKILLRFRHENIIGINDIIRAPTIEQMKDVYIVQDLMETDLYKLLKTQHLSNDHICYFLYQILRGLKYIHSANVLHRDLKPSNLLLNTTCDLKICDFGLARVADPDHDHTGFLTEYVATRWYRAPEIMLNSKGYTKSIDIWSVGCILAEMLSNRPIFPGKHYLDQLNHILGILGSPSQEDLNCI

SEQ ID NO: 3188 - protein, 255 aa, Homo sapiens
MEVPPATKFGETFAFENRLESQQGLFPGEDLGDPFLQERGLEQMAVIYKEIPLGEQDEENDDYEGNFSLCSSPVQHQSIPPGTRPQDDELFGQTFLQKSDLSMCQIIHSEEPSPCDCAETDRGDSGPNAPHRTPQPAKPYACRECGKAFSQSSHLLRHLVIHTGEKPYECCECGKAFSQSSHLLRHQIIHTGEKPYECRECGKAFRQSSALTQHQKIHTGKRPYECRECGKDFSRSSSLRKHERIHTGERPYQCK

SEQ ID NO: 3189 - protein, 255 aa, Homo sapiens
MRLSVRRVLLAAGCALVLVLAVQLGQQVLECRAVLAGLRSPRGAMRPEQEELVMVGTNHVEYRYGKAMPLIFVGGVPRSGTTLMRAMLDAHPEVRCGEETRIIPRVLAMRQAWSKSGREKLRLDEAGVTDEVLDAAMQAFILEVIAKHGEPARVLCNKDPFTLKSSVYLSRLFPNSKFLLMVRDGRASVHSMITRKVTIAGFDLSSYRDCLTKWNKAIEVMYAQCMEVGKEKCLPVYYEQLVLHPRRSLKLILDF

SEQ ID NO: 3190 - protein, 255 aa, Homo sapiens
MPAGPVQAVPPPPPVPTEPKQPTEEEASSKEDSAPSKPVVGIIYPPPEVRNIVDKTASFVARNGPEFEARIRQNEINNPKFNFLNPNDPYHAYYRHKVSEFKEGKAQEPSAAIPKVMQQQQQTTQQQLPQKVQAQVIQETIVPKEPPPEFEFIADPPSISAFDLDVVKLTAQFVARNGRQFLTQLMQKEQRNYQFDFLRPQHSLFNYFTKLVEQYTKILIPPKGLFSKLKKEAENPREVLDQVCYRVEWAKFQER

SEQ ID NO: 3191 - protein, 583 aa, Homo sapiens
MGGLEKKKYERGSATNYITRNKARKKLQLSLADFRRLCILKGIYPHEPKHKKKVNKGSTAARTFYLIKDIRFLLHEPIVNKFREYKVFVRKLRKAYGKSEWNTVERLKDNKPNYKLDHIIKERYPTFIDALRDLDDALSMCFLFSTFPRTGKCHVQTIQLCRRLTVEFMHYIIAARALRKVFLSIKGIYYQAEVLGQPIVWITPYAFSHDHPTDVDYRVMATFTEFYTTLLGFVNFRLYQLLNLHYPPKLEGQAQAEAKAGEGTYALDSESCMEKLAALSASLARVVVPATEEEAEVDEFPTDGEEDRRKELEAQEKHKKLFEGLKFFLNREVPREALAFIIRSFGGEVSWDKSLCIGATYDVTDSRITHQIVDRPGQQTSVIGRCYVQPQWVFDSVNARLLLPVAEYFSGVQLPPHLSPFVTEKEGDYVPPEKLKLLALQRGEDPGNLNESEEEEEEDDNNEGDGDEEGENEEEEEDAEAGSEKEEEARLAALEEQRMEGKKPRVMAGTLKLEDKQRLAQEEESEAKRLAIMMMKKREKYLYQKIMFGKRRKIREANKLAEKRKAHDEAVRSEKKAKKARPE

SEQ ID NO: 3192 - protein, 255 aa, Homo sapiens
MLLAWVQAFLVSNMLLAEAYGSGGCFWDNGHLYREDQTSPAPGLRCLNWLDAQSGLASAPVSGAGNHSYCRNPDEDPRGPWCYVSGEAGVPEKRPCEDLRCPETTSQALPAFTTEIQEASEGPGADEVQVFAPANALPARSEAAAVQPVIGISQRVRMNSKEKKDLGTLGYVLGITMMVIIIAIGAGIILGYSYKRGKDLKEQHDQKVCEREMQRITLPLSAFTNPTCEIVDEKTVVVHTSQTPVDPQEGTTPLM

SEQ ID NO: 3193 - protein, 255 aa, Homo sapiens
MERVNDASCGPSGCYTYQVSRHSTEMLHNLNQQRKNGGRFCDVLLRVGDESFPAHRAVLAACSEYFESVFSAQLGDGGAADGGPADVGGATAAPGGGAGGSRELEMHTISSKVFGDILDFAYTSRIVVRLESFPELMTAAKFLLMRSVIEICQEVIKQSNVQILVPPARADIMLFRPPGTSDLGFPLDMTNGAALAANSNGIAGSMQPEEEAARAAGAAIAGQASLPVLPGVDRLPMVAGPLSPQLLTSPFPSVA

SEQ ID NO: 3194 - protein, 255 aa, Homo sapiens
MLSSGVETQPVPLDSSMSAVVQELYSELPVSVSRELHADPEPSVIPDVKPGASSSLLSQNRALPLELQRTHVESCCEETYETLDHGSEPGRCGLVDSTAGGSVASGILDRAKRSESMEPKVFRDPGGQAGIIREPSEGAKEDPHQHSTAAEEKTSPSQEDLLMQSSKELSHVDLPEDFLRSKEGNVQITAETLLKSAEVQGMKVNGTKTDNNEGHKNGNVSKDLSAGCGEFQEVDKIMTSDEVSETSTLVTPEPL

SEQ ID NO: 3195 - protein, 255 aa, Homo sapiens
MAAPALSWRLPLLILLLPLATSWASAAVNGTSQFTCFYNSRANISCVWSQDGALQDTSCQVHAWPDRRRWNQTCELLPVSQASWACNLILGAPDSQKLTTVDIVTLRVLCREGVRWRVMAIQDFKPFENLRLMAPISLQVVHVETHRCNISWEISQASHYFERHLEFEARTLSPGHTWEEAPLLTLKQKQEWICLETLTPDTQYEFQVRVKPLQGEFTTWSPWSQPLAFRTKPAALGKDTIPWLGHLLVGLSGAF

SEQ ID NO: 3196 - protein, 255 aa, Homo sapiens
MELRVGNKYRLGRKIGSGSFGDIYLGANIASGEEVAIKLECVKTKHPQLHIESKFYKMMQGGVGIPSIKWCGAEGDYNVMVMELLGPSLEDLFNFCSRKFSLKTVLLLADQMISRIEYIHSKNFIHRDVKPDNFLMGLGKKGNLVYIIDFGLAKKYRDARTHQHIPYRENKNLTGTARYASINTHLGIEQSRRDDLESLGYVLMYFNLGSLPWQGLKAATKRQKYERISEKKMSTPIEVLCKGYPSEFSTYLNFC

SEQ ID NO: 3197 - protein, 255 aa, Homo sapiens
MSRRSQRLTRYSQGDDDGSSSSGGSSVAGSQSTLFKDSPLRTLKRKSSNMKRLSPAPQLGPSSDAHTSYYSESLVHESWFPPRSSLEELHGDANWGEDLRVRRRRGTGGSESSRASGLVGRKATEDFLGSSSGYSSEDDYVEDSEGRGSKVTETEPVSSFPAGYSDVDQQSSSSRLRSAVSRAGSLLWMVATSPGRLFRLLYWWAGTTWYRLTTAASLLDVFVLTRRFSSLKTFLWFLLPLLLLTCLTYGAWYFY

SEQ ID NO: 3198 - protein, 251 aa, Homo sapiens
MELSAIGEQVFAVESIRKKRVRKGKVEYLVKWKGWPPKYSTWEPEEHILDPRLVMAYEEKEERDRASGYRKRGPKPKRLLLQRLYSMDLRSSHKAKGKEKLCFSLTCPLGSGSPEGVVKAGAPELVDKGPLVPTLPFPLRKPRKAHKYLRLSRKKFPPRGPNLESHSHRRELFLQEPPAPDVLQAAGEWEPAAQPPEEEADADLAEGPPPWTPALPSSEVTVTDITANSITVTFREAQAAEGFFRDRSGKF

SEQ ID NO: 3199 - protein, 136 aa, Homo sapiens
MSAALLRRGLELLAASEAPRDPPGQAKPRGAPVKRPRKTKAIQAQKLRNSAKGKVPKSALDEYRKRECRDHLRVNLKFLTRTRSTVAESVSQQILRQNRGRKACDRPVAKTKKKKAEGTVFTEEDFQKFQQEYFGS

SEQ ID NO: 3200 - protein, 255 aa, Homo sapiens
MPPLKSPAAFHEQRRSLERARTEDYLKRKIRSRPERSELVRMHILEETSAEPSLQAKQLKLKRARLADDLNEKIAQRPGPMELVEKNILPVESSLKEAIIVGQVNYPKVADSSSFDEDSSDALSPEQPASHESQGSVPSPLEARVSEPLLSATSASPTQVVSQLPMGRDSREMLFLAEQPPLPPPPLLPPSLTNGTTIPTAKSTPTLIKQSQPKSASEKSQRSKKAKELKPKVKKLKYHQYIPPDQKQDRGAPPM

SEQ ID NO: 3201 - protein, 255 aa, Homo sapiens
MASEDIAKLAETLAKTQVAGGQLSFKGKSLKLNTAEDAKDVIKEIEDFDSLEALRLEGNTVGVEAARVIAKALEKKSELKRCHWSDMFTGRLRTEIPPALISLGEGLITAGAQLVELDLSDNAFGPDGVQGFEALLKSSACFTLQELKLNNCGMGIGGGKILAAALTECHRKSSAQGKPLALKVFVAGRNRLENDGATALAEAFRVIGTLEEVHMPQNGINHPGITALAQAFAVNPLLRVINLNDNTFTEKGAVA

SEQ ID NO: 3202 - protein, 255 aa, Homo sapiens
MQSFREQSSYHGNQQSYPQEVHGSSRLEEFSPRQAQMFQNFGGTGGSSGSSGSGSGGGRRGAAAAAAAMASETSGHQGYQGFRKEAGDFYYMAGNKDPVTTGTPQPPQRRPSGPVQSYGPPQGSSFGNQYGSEGHVGQFQAQHSGLGGVSHYQQDYTGPFSPGSAQYQQQASSQQQQQQVQQLRQQLYQSHQPLPQATGQPASSSSHLQPMQRPSTLPSSAAGYQLRVGQFGQHYQSSASSSSSSSFPSPQRFSQ

SEQ ID NO: 3203 - protein, 239 aa, Homo sapiens
MVQPQTSKAESPALAASPNAQMDDVIDTLTSLRLTNSALRREASTLRAEKANLTNMLESVMAELTLLRTRARIPGALQITPPISSITSNGTRPMTTPPTSLPEPFSGDPGRLAGFLMQMDRFMIFQASRFPGEAERVAFLVSRLTGEAEKWAIPHMQPDSPLRNNYQGFLAELRRTYKSPLRHARRAQIRKTSASNRAVRERQMLCRQLASAGTGPCPVHPASNGTSPAPALPARARNL

SEQ ID NO: 3204 - protein, 157 aa, Homo sapiens
MLPEQGPQPSTMPLWCLLAACTSLPRQAATMLEEAASPNEAVHASTSGSGALTDQTFTDLSAAEASSEEVPDFMEVPHSVHHKINCFFYLEKQLCQLPSPLCLSSLLTLKLKTTVPAPGRWWSFQPHKAFPLLVGTPGSWQSTIDPAWAAPSQPSPG

SEQ ID NO: 3205 - protein, 255 aa, Homo sapiens
MASITQLFDDLCEALLPAAKTHLGQRSVNRKRAKRSLKKVAYNALFTNLFQDETQQLQPDMSKLPARNKILMLSFDLRVGGLGPKADRLEELVEELEAAPCCPLLEVGSVLDLLVQLAGSGPPQVLPRKRDYFLNNKHVGRNVPYSGYDCDDLSVFEMDVQSLISREECLCHSMIQETLQVMEAAPGTGLPTVGLFSFGDPCGDRFERDTRVSLFGALVHSRTYDMDVRLGLPPVPDNADLSGLAIKVPPSVDQW

SEQ ID NO: 3206 - protein, 255 aa, Homo sapiens
MARLADYFVLVAFGPHPRGSGEGQGQILQRFPEKDWEDNPFPQGIELFCQPSGWQLCPERNPPTFFVAVLTDINSERHYCACLTFWEPAEPSQETTRVEDATEREEEGDEGGQTHLSPTAPAPSAQLFAPKTLVLVSRLDHTEVFRNSLGLIYAIHVEGLNVCLENVIGNLLTCTVPLAGGSQRTISLGAGDRQVIQTPLADSLPVSRCSVALLFRQLGITNVLSLFCAALTEHKVLFLSRSYQRLADACRGLLA

SEQ ID NO: 3207 - protein, 255 aa, Homo sapiens
MEERTITIEIPEVLKKQLEDDCYYINRRKRLVKLPCQTNIITILESYVKHFAINAAFSANERPRHHHVMPHANMNVHYIPAEKNVDLCKEMVDGLRITFDYTLPLVLLYPYEQAQYKKVTSSKFFLPIKESATSTNRSQEELSPSPPLLNPSTPQSTESQPTTGEPATPKRRKAEPEALQSLRRSTRHSANCDRLSESSASPQPKRRQQDTSASMPKLFLHLEKKTPVHSRSSSPIPLTPSKEGSAVFAGFEGRR

SEQ ID NO: 3208 - protein, 255 aa, Homo sapiens
MTSKQAMSSNEQERLLCYNGEVLVFQLSKGNFADKEPTKTPILHVRRMVFDRGTKVFVQKSTGFFTIKEENSHLKIMCCNCVSDFRTGINLPYIVIEKNKKNNVFEYFLLILHSTNKFEMRLSFKLGYEMKDGLRVLNGPLILWRHVKAFFFISSQTGKVVSVSGNFSSIQWAGEIENLGMVLLGLKECCLSEEECTQEPSKSDYAIWNTKFCVYSLESQEVLSDIYIIPPAYSSVVTYVHICATEIIKNQLRIS

SEQ ID NO: 3209 - protein, 255 aa, Homo sapiens
MGSSKKVTLSVLSREQSEGVGARVRRSIGRPELKNLDPFLLFDEFKGGRPGGFPDHPHRGFETVSYLLEGGSMAHEDFCGHTGKMNPGDLQWMTAGRGILHAEMPCSEEPAHGLQLWVNLRSSEKMVEPQYQELKSEEIPKPSKDGVTVAVISGEALGIKSKVYTRTPTLYLDFKLDPGAKHSQPIPKGWTSFIYTISGDVYIGPDDAQQKIEPHHTAVLGEGDSVQVENKDPKRSHFVLIAGEPLREPVIQHGP

SEQ ID NO: 3210 - protein, 255 aa, Homo sapiens
MRKMLAAVSRVLSGASQKPRHGLATLPSLVSISRLKQSSHLGLPKCWDYSHSLKTRQASRVLVASRNFANDATFEIKKCDLHRLEEGPPVTTVLTREDGLKYYRMMQTVRRMELKADQLYKQKIIRGFCHLCDGQEACCVGLEAGINPTDHLITAYRAHGFTFTRGLSVREILAELTGRKGGCAKGKGGSMHMYAKNFYGGNGIVGAQVPLGAGIALACKYNGKDEVCLTLYGDGAANQGQIFEAYNMAALWKLP

SEQ ID NO: 3211 - protein, 255 aa, Homo sapiens
MASNEDFSITQDLEIPADIVELHDINVEPLPMEDIPTESVQYEDVDGNWIYGGHNHPPLMVLQPLFTNTGYGDHDQEMLMLQTQEEVVGYCDSDNQLGNDLEDQLALPDSIEDEHFQMTLASLSASAASTSTSTQSRSKKPSKKPSGKSATSTEANPAGSSSSLGTRKWEQKQMQVKTLEGEFSVTMWSPNDNNDQGAVGEGQAENPPDYSEYLKGKKLPPGGLPGIDLSDPKQLAEFTKVKPKRSKGEPPKTVP

SEQ ID NO: 3212 - protein, 255 aa, Homo sapiens
MRLFRWLLKQPVPKQIERYSRFSPSPLSIKQFLDFGRDNACEKTSYMFLRKELPVRLANTMREVNLLPDNLLNRPSVGLVQSWYMQSFLELLEYENKSPEDPQVLDNFLQVLIKVRNRHNDVVPTMAQGVIEYKEKFGFDPFISTNIQYFLDRFYTNRISFRMLINQHTLLFGGDTNPVHPKHIGSIDPTCNVADVVKDAYETAKMLCEQYYLVAPELEVEEFNAKAPDKPIQVVYVPSHLFHMLFELFKNSMRA

SEQ ID NO: 3213 - protein, 255 aa, Homo sapiens
MAASKKAVLGPLVGAVDQGTSSTRFLVFNSKTAELLSHHQVEIKQEFPREGWVEQDPKEILHSVYECIEKTCEKLGQLNIDISNIKAIGVSNQRETTVVWDKITGEPLYNAVVWLDLRTQSTVESLSKRIPGNNNFVKSKTGLPLSTYFSAVKLRWLLDNVRKVQKAVEEKRALFGTIDSWLIWSLTGGVNGGVHCTDVTNASRTMLFNIHSLEWDKQLCEFFGIPMEILPNVRSSSEIYGLMKAGALEGVPISG

SEQ ID NO: 3214 - protein, 255 aa, Homo sapiens
MAIHLDKQNIILKNDKDEYLKKTRDGVLPPYQDAKPPSPASIKKTYTTSKFNDAEPAKGNLFIGVEVLPENLHLDESETSEEDHGSLEKEKYEQFLSLEEGTKAHYFFEKVVNAAQTWFSLFGWPEGPHSFSIPETIRRDVYKMQFYSSTSPPQKFSRQNDFSKYNKTIYDVLLHLSGKMPPGINSSQSLPVDNHEKRVIQLHLQHSSLLDFLNAQGGCISHVLPEFLLEPEDYKRWIEIMSSTNTMPVSSCTPK

SEQ ID NO: 3215 - protein, 255 aa, Homo sapiens
MAVFVVLLALVAGVLGNEFSILKSPGSVVFRNGNWPIPGERIPDVAALSMGFSVKEDLSWPGLAVGNLFHRPRATVMVMVKGVNKLALPPGSVISYPLENAVPFSLDSVANSIHSLFSEETPVVLQLAPSEERVYMVGKANSVFEDLSVTLRQLRNRLFQENSVLSSLPLNSLSRNNEVDLLFLSELQVLHDISSLLSRHKHLAKDHSPDLYSLELAGLDEIGKRYGEDSEQFRDASKILVDALQKFADDMYSLY

SEQ ID NO: 3216 - protein, 255 aa, Homo sapiens
MTATTRGSPVGGNDNQGQAPDGQSQPPLQQNQTSSPDSSNENSPATPPDEQGQGDAPPQLEDEEPAFPHTDLAKLDDMINRPRWVVPVLPKGELEVLLEAAIDLSKKGLDVKSEACQRFFRDGLTISFTKILTDEAVSGWKFEIHRCIINNTHRLVELCVAKLSQDWFPLLELLAMALNPHCKFHIYNGTRPCESVSSSVQLPEDELFARSPDPRSPKGWLVDLLNKFGTLNGFQILHDRFINGSALNVQIIAAL

SEQ ID NO: 3217 - protein, 255 aa, Homo sapiens
MGCFFSKRRKADKESRPENEEERPKQYSWDQREKVDPKDYMFSGLKDETVGRLPGTVAGQQFLIQDCENCNIYIFDHSATVTIDDCTNCIIFLGPVKGSVFFRNCRDCKCTLACQQFRVRDCRKLEVFLCCATQPIIESSSNIKFGCFQWYYPELAFQFKDAGLSIFNNTWSNIHDFTPVSGELNWSLLPEDAVVQDYVPIPTTEELKAVRVSTEANRSIVPISRGQRQKSSDESCLVVLFAGDYTIANARKLID

SEQ ID NO: 3218 - protein, 255 aa, Homo sapiens
MAVAPRLFGGLCFRFRDQNPEVAVEGRLPISHSCVGCRRERTAMATVAANPAAAAAAVAAAAAVTEDREPQHEELPGLDSQWRQIENGESGRERPLRAGESWFLVEKHWYKQWEAYVQGGDQDSSTFPGCINNATLFQDEINWRLKEGLVEGEDYVLLPAAAWHYLVSWYGLEHGQPPIERKVIELPNIQKVEVYPVELLLVRHNDLGKSHTVQFSHTDSIGLVLRTARERFLVEPQEDTRLWAKNSEGSLDRLY

SEQ ID NO: 3219 - protein, 157 aa, Homo sapiens
MSSEEGKLFVGGLNFNTDEQALEDHFSSFGPISEVVVVKDRETQRSRGFGFITFTNPEHASVAMRAMNGESLDGRQIRVDHAGKSARGTRGGGFGAHGRGRSYSRGGGDQGYGSGRYYDSRPGGYGYGYGRSRDYNGRNQGGYDRYSGGNYRDNYDN

SEQ ID NO: 3220 - protein, 255 aa, Homo sapiens
MGRTSKDKRDVYYRLAKENGWRARSAFKLLQLDKEFQLFQGVTRAVDLCAAPGSWSQVLSQKIGGQGSGHVVAVDLQAMAPLPGVVQIQGDITQLSTAKEIIQHFKGCPADLVVCDGAPDVTGLHDVDEYMQAQLLLAALNIATHVLKPGGCFVAKIFRGRDVTLLYSQLQVFFSSVLCAKPRSSRNSSIEAFAVCQGYDPPEGFIPDLSKPLLDHSYDFNQLDGPTRIIVPFVTCGDLSSYDSDRSYPLDLEGG

SEQ ID NO: 3221 - protein, 255 aa, Homo sapiens
MSGGPMGGRPGGRGAPAVQQNIPSTLLQDHENQRLFEMLGRKCLTLATAVVQLYLALPPGAEHWTKEHCGAVCFVKDNPQKSYFIRLYGLQAGRLLWEQELYSQLVYSTPTPFFHTFAGDDCQAGLNFADEDEAQAFRALVQEKIQKRNQRQSGDRRQLPPPPTPANEERRGGLPPLPLHPGGDQGGPPVGPLSLGLATVDIQNPDITSSRYRGLPAPGPSPADKKRSGKKKISKADIGAPSGFKHVSHVGWDPQ

SEQ ID NO: 3222 - protein, 152 aa, Homo sapiens
MADSERLSAPGCWAACTNFSRTRKGILLFAEIILCLVILICFSASTPGYSSLSVIEMILAAIFFVVYMCDLHTKIPFINWPWSDFFRTLIAAILYLITSIVVLVERGNHSKIVAGVLGLIATCLFGYDAYVTFPVRQPRHTAAPTDPADGPV

SEQ ID NO: 3223 - protein, 255 aa, Homo sapiens
MDRPDEGPPAKTRRLSSSESPQRDPPPPPPPPPLLRLPLPPPQQRPRLQEETEAAQVLADMRGVGLGPALPPPPPYVILEEGGIRAYFTLGAECPGWDSTIESGYGEAPPPTESLEALPTPEASGGSLEIDFQVVQSSSFGGEGALETCSAVGWAPQRLVDPKSKEEAIIIVEDEDEDERESMRSSRRRRRRRRRKQRKVKRESRERNAERMESILQALEDIQLDLEAVNIKAGKAFLRLKRKFIQMRRPFLERR

SEQ ID NO: 3224 - protein, 255 aa, Homo sapiens
MSDTSESGAGLTRFQAEASEKDSSSMMQTLLTVTQNVEVPETPKASKALEVSEDVKVSKASGVSKATEVSKTPEAREAPATQASSTTQLTDTQVLAAENKSLAADTKKQNADPQAVTMPATETKKVSHVADTKVNTKAQETEAAPSQAPADEPEPESAAAQSQENQDTRPKVKAKKARKVKHLDGEEDGSSDQSQASGTTGGRRVSKALMASMARRASRGPIAFWARRASRTRLAAWARRALLSLRSPKARRGKA

SEQ ID NO: 3225 - protein, 255 aa, Homo sapiens
MAENGESSGPPRPSRGPAAAQGSAAAPAEPKIIKVTVKTPKEKEEFAVPENSSVQQFKEAISKRFKSQTDQLVLIFAGKILKDQDTLIQHGIHDGLTVHLVIKSQNRPQGQSTQPSNAAGTNTTSASTPRSNSTPISTNSNPFGLGSLGGLAGLSSLGLSSTNFSELQSQMQQQLMASPEMMIQIMENPFVQSMLSNPDLMRQLIMANPQMQQLIQRNPEISHLLNNPDIMRQTLEIARNPAMMQEMMRNQDLAL

SEQ ID NO: 3226 - protein, 255 aa, Homo sapiens
MWLRLGPPSLSLSPKPTVGRSLCLTLWFLSLALRASTQAPAPTVNTHFGKLRGARVPLPSEILGPVDQYLGVPYAAPPIGEKRFLPPEPPPSWSGIRNATHFPPVCPQNIHTAVPEVMLPVWFTANLDIVATYIQEPNEDCLYLNVYVPTEDVKRISKECARKPNKKICRKGGSGAKKQGEDLADNDGDEDEDIRDSGAKPVMVYIHGGSYMEGTGNMIDGSILASYGNVIVITLNYRVGVLGFLSTGDQAAKGN

SEQ ID NO: 3227 - protein, 255 aa, Homo sapiens
MDGCKKELPRLQEPEEDEDCYILNVQSSSDDTSGSSVARRAPKRQASCILNVQSRSGDTSGSSVARRAPKRQASSVVVIDSDSDEECHTHEEKKAKLLEINSDDESPECCHVKPAIQEPPIVISDDDNDDDNGNDLEVPDDNSDDSEAPDDNSDDSEAPDDNSDDSEAPDDNSDDSEAPDDNSDDSDVPDDNSDDSSDDNSDDSSDDNSDDSDVPDDKSDDSDVPDDSSDDSDVPDDSSDDSEAPDDSSDDSEAP

SEQ ID NO: 3228 - protein, 309 aa, Homo sapiens
MATELQCPDSMPCHNQQVNSASTPSPEQLRPGDLILDHAGGNRASRAKVILLTGYAHSSLPAELDSGACGGSSLNSEGNSGSGDSSSYDAPAGNSFLEDCELSRQIGAQLKLLPMNDQIRELQTIIRDKTASRGDFMFSADRLIRLVVEEGLNQLPYKECMVTTPTGYKYEGVKFEKGNCGVSIMRSGEAMEQGLRDCCRSIRIGKILIQSDEETQRAKVYYAKFPPDIYRRKVLLMYPILSTGNTVIEAVKVLIEHGVQPSVIILLSLFSTPHGAKSIIQEFPEITILTTEVHPVAPTHFGQKYFGTD

SEQ ID NO: 3229 - protein, 233 aa, Homo sapiens
MAATSGTDEPVSGELVSVAHALSLPAESYGNDPDIEMAWAMRAMQHAEVYYKLISSVDPQFLKLTKVDDQIYSEFRKNFETLRIDVLDPEELKSESAKEKWRPFCLKFNGIVEDFNYGTLLRLDCSQGYTEENTIFAPRIQFFAIEIARNREGYNKAVYISVQDKEGEKGVNNGGEKRADSGEEENTKNGGEKGADSGEEKEEGINREDKTDKGGEKGKEADKEINKSGEKAM

SEQ ID NO: 3230 - protein, 255 aa, Homo sapiens
MDPSMGVNSVTISVEGMTCNSCVWTIEQQIGKVNGVHHIKVSLEEKNATIIYDPKLQTPKTLQEAIDDMGFDAVIHNPDPLPVLTDTLFLTVTASLTLPWDHIQSTLLKTKGVTDIKIYPQKRTVAVTIIPSIVNANQIKELVPELSLDTGTLEKKSGACEDHSMAQAGEVVLKMKVEGMTCHSCTSTIEGKIGKLQGVQRIKVSLDNQEATIVYQPHLISVEEMKKQIEAMGFPAFVKKQPKYLKLGAIDVERL

SEQ ID NO: 3231 - protein, 255 aa, Homo sapiens
MEQPGAAASGAGGGSEEPGGGRSNKRSAGNRAANEEETKNKPKLNIQIKTLADDVRDRITSFRKSTVKKEKPLIQHPIDSQVAMSEFPAAQPLYDERSLNLSEKEVLDLFEKMMEDMNLNEEKKAPLRNKDFTTKREMVVQYISATAKSGGLKNSKHECTLSSQEYVHELRSGISDEKLLNCLESLRVSLTSNPVSWVNNFGHEGLGLLLDELEKLLDKKQQENIDKKNQYKLIQCLKAFMNNKFGLQRILGDER

SEQ ID NO: 3232 - protein, 255 aa, Homo sapiens
MAGLTVRDPAVDRSLRSVFVGNIPYEATEEQLKDIFSEVGPVVSFRLVYDRETGKPKGYGFCEYQDQETALSAMRNLNGREFSGRALRVDNAASEKNKEELKSLGTGAPVIESPYGETISPEDAPESISKAVASLPPEQMFELMKQMKLCVQNSPQEARNMLLQNPQLAYALLQAQVVMRIVDPEIALKILHRQTNIPTLIAGNPQPVHGAGPGSGSNVSMNQQNPQAPQAQSLGGMHVNGAPPLMQASMQGGVP

SEQ ID NO: 3233 - protein, 255 aa, Homo sapiens
MGYARKVGWVTAGLVIGAGACYCIYRLTRGRKQNKEKMAEGGSGDVDDAGDCSGARYNDWSDDDDDSNESKSIVWYPPWARIGTEAGTRARARARARATRARRAVQKRASPNSDDTVLSPQELQKVLCLVEMSEKPYILEAALIALGNNAAYAFNRDIIRDLGGLPIVAKILNTRDPIVKEKALIVLNNLSVNAENQRRLKVYMNQVCDDTITSRLNSSVQLAGLRLLTNMTVTNEYQHMLANSISDFFRLFSAG

SEQ ID NO: 3234 - protein, 255 aa, Homo sapiens
MVDSGTEARARGKAEAGLQDGISGPATARVNGKTQAEAVAEAELKTESVTQAKAGDGAMTRTHTVTYREAMAVTREVIKVEDTTKTRVMVETKTKPLAERSIVPQTKSKAMPMSRVSTVTKSEVKVVAVIEANIRSYAKSHDKANTGSRPDRREETSIGMKSSDEDEENICSWFWTGEEPSVGSWFWPEEETSLQVYKPLPKIQEKPKPTHKPTLTIKQKVIAWSRARYIVLVPVEGGEQSLPPEGNWTLVETLI

SEQ ID NO: 3235 - protein, 255 aa, Homo sapiens
MTGAEIESGAQVKPEKKPGEEVVGGAEIENDVPLVVRPKVRTQAQIMPGARPKNKSKVMPGASTKVETSAVGGARPKSKAKAIPVSRFKEEAQMWAQPRFGAERLSKTERNSQTNIIASPLVSTDSVLVAKTKYLSEDRELVNTDTESFPRRKAHYQAGFQPSFRSKEETNMGSWCCPRPTSKQEASPNSDFKWVDKSVSSLFWSGDEVTAKFHPGNRVKDSNRSMHMANQEANTMSRSQTNQELYIASSSGSED

SEQ ID NO: 3236 - protein, 168 aa, Homo sapiens
MRLTEKSEGEQQLKPNNSNAPNEDQEEEIQQSEQHTPARQRTQRADTQPSRCRLPSRRTPTTSSDRTINLLEVLPWPTEWIFNPYRLPALFELYPEFLLVFKEAFHDISHCLKAQMEKIGLPIILHLFALSTLYFYKFFLPTILSLSFFILLVLLLLLFIIVFILIFF

SEQ ID NO: 3237 - protein, 255 aa, Homo sapiens
MWLKPEEVLLKNALKLWLMERSNDYFVLQRRRGYGEEGGGGLTGLLVGTLDSVLDSTAKVAPFRILHQTPDSQVYLSIACGANREEITKHWDWLEQNIMKTLSVFDSNEDITNFVQGKIRGLIAEEGKHCFAKEDDPEKFREALLKFEKCFGLPEKEKLVTYYSCSYWKGRVPCQGWLYLSTNFLSFYSFLLGSEIKLIISWDEVSKLEKTSNVILTESIHVCSQGENHYFSMFLHINQTYLLMEQLANYAIRRL

SEQ ID NO: 3238 - protein, 255 aa, Homo sapiens
MGESPASVVLNASGGLFSLKMETLESELTCPICLELFEDPLLLPCAHSLCFSCAHRILVSSCSSGESIEPITAFQCPTCRYVISLNHRGLDGLKRNVTLQNIIDRFQKASVSGPNSPSESRRERTYRPTTAMSSERIACQFCEQDPPRDAVKTCITCEVSYCDRCLRATHPNKKPFTSHRLVEPVPDTHLRGITCLDHENEKVNMYCVSDDQLICALCKLVGRHRDHQVASLNDRFEKLKQTLEMNLTNLVKRNS

SEQ ID NO: 3239 - protein, 255 aa, Homo sapiens
MAEVRKFTKRLSKPGTAAELRQSVSEAVRGSVVLEKAKVVEPLDYENVIAQRKTQIYSDPLRDLLMFPMEDISISVIGRQRRTVQSTVPEDAEKRAQSLFVKECIKTYSTDWHVVNYKYEDFSGDFRMLPCKSLRPEKIPNHVFEIDEDCEKDEDSSSLCSQKGGVIKQGWLHKANVNSTITVTMKVFKRRYFYLTQLPDGSYILNSYKDEKNSKESKGCIYLDACIDVVQCPKMRRHAFELKMLDKYSHYLAAE

SEQ ID NO: 3240 - protein, 255 aa, Homo sapiens
MESVRIEQMLSLPAEVSSDNLESAERGASAAQVDMGPHPKVAAEGPAPLPTREPEQEQSPGTSTPESKVLLTQADALASRGRIREALEVYRQLSERQQLVAEQLEQLVRCLAEKVPQGEALAPAPPDEGSTASGTVAAEETGAAAAAAATEVWDGFKCRKCHGFLSDPVSLSCGHTFCKLCLERGRAADRRCALCGVKLSALMVATGRARGARRAGQQPPPPLRVNVVLSGLLGKLFPGPARASQLRHEGNRLYR

SEQ ID NO: 3241 - protein, 152 aa, Homo sapiens
MSTPARRRLMRDFKRLQEDPPAGVSGAPSENNIMVWNAVIFGPEGTPFEDGTFKLTIEFTEEYPNKPPTVRFVSKMFHPNVYADGSICLDILQNRWSPTYDVSSILTSIQSLLDEPNPNSPANSQAAQLYQENKREYEKRVSAIVEQSWRDC

SEQ ID NO: 3242 - protein, 128 aa, Homo sapiens
MDAVAVYHGKISRETGEKLLLATGLDGSYLLRDSESVPGVYCLCVLYHGYIYTYRVSQTETGSWSAETAPGVHKRYFRKIKNLISAFQKPDQGIVIPLQYPVEKKSSARSTQGTTGIREDPDVCLKAP

SEQ ID NO: 3243 - protein, 255 aa, Homo sapiens
MEPPLPVGAQPLATVEGMEMKGPLREPCALTLAQRNGQYELIIQLHEKEQHVQDIIPINSHFRCVQEAEETLLIDIASNSGCKIRVQGDWIRERRFEIPDEEHCLKFLSAVLAAQKAQSQLLVPEQKDSSSWYQKLDTKDKPSVFSGLLGFEDNFSSMNLDKKINSQNQPTGIHREPPPPPFSVNKMLPREKEASNKEQPKVTNTMRKLFVPNTQSGQREGLIKHILAKREKEYVNIQTFRFFVGTWNVNGQSPD

SEQ ID NO: 3244 - protein, 325 aa, Homo sapiens
MGIFPGIILIFLRVKFATAAVIVSGHQKSTTVSHEMSGLNWKPFVYGGLASIVAEFGTFPVDLTKTRLQVQGQSIDARFKEIKYRGMFHALFRICKEEGVLALYSGIAPALLRQASYGTIKIGIYQSLKRLFVERLEDETLLINMICGVVSGVISSTIANPTDVLKIRMQAQGSLFQGSMIGSFIDIYQQEGTRGLWRGVVPTAQRAAIVVGVELPVYDITKKHLILSGMMGDTILTHFVSSFTCGLAGALASNPVDVVRTRMMNQRAIVGHVDLYKGTVDGILKMWKHEGFFALYKGFWPNWLRLGPWNIIFFITYEQLKRLQI

SEQ ID NO: 3245 - protein, 218 aa, Homo sapiens
MATRSPGVVISDDEPGYDLDLFCIPNHYAEDLERVFIPHGLIMDRTERLARDVMKEMGGHHIVALCVLKGGYKFFADLLDYIKALNRNSDRSIPMTVDFIRLKSYCNDQSTGDIKVIGGDDLSTLTGKNVLIVEDIIDTGKTMQTLLSLVRQYNPKMVKVASLLVKRTPRSVGYKPDFVGFEIPDKFVVGYALDYNEYFRDLNHVCVISETGKAKYKA

SEQ ID NO: 3246 - protein, 255 aa, Homo sapiens
MIETYNQTSPRSAATGLPISMKIFMYLLTVFLITQMIGSALFAVYLHRRLDKIEDERNLHEDFVFMKTIQRCNTGERSLSLLNCEEIKSQFEGFVKDIMLNKEETKKENSFEMQKGDQNPQIAAHVISEASSKTTSVLQWAEKGYYTMSNNLVTLENGKQLTVKRQGLYYIYAQVTFCSNREASSQAPFIASLCLKSPGRFERILLRAANTHSSAKPCGQQSIHLGGVFELQPGASVFVNVTDPSQVSHGTGFTS

SEQ ID NO: 3247 - protein, 255 aa, Homo sapiens
MDLFDFFRDWDLEQQCHYEQDRSALKKREWERRNQEVQQEDDLFSSGFDLFGEPYKVAEYTNKGDALANRVQNTLGNYDEMKNLLTNHSNQNHLVGIPKNSVPQNPNNKNEPSFFPEQKNRIIPPHQDNTHPSAPMPPPSVVILNSTLIHSNRKSKPEWSRDSHNPSTVLASQASGQPNKMQTLTQDQSQAKLEDFFVYPAEQPQIGEVEESNPSAKEDSNPNSSGEDAFKEIFQSNSPEESEFAVQAPGSPLVA

SEQ ID NO: 3248 - protein, 255 aa, Homo sapiens
MALKVATVAGSAAKAVLGPALLCRPWEVLGAHEVPSRNIFSEQTIPPSAKYGGRHTVTMIPGDGIGPELMLHVKSVFRHACVPVDFEEVHVSSNADEEDIRNAIMAIRRNRVALKGNIETNHNLPPSHKSRNNILRTSLDLYANVIHCKSLPGVVTRHKDIDILIVRENTEGEYSSLEHESVAGVVESLKIITKAKSLRIAEYAFKLAQESGRKKVTAVHKANIMKLGDGLFLQCCREVAARYPQITFENMIVDN

SEQ ID NO: 3249 - protein, 255 aa, Homo sapiens
MAQYKGAASEAGRAMHLMKKREKQREQMEQMKQRIAEENIMKSNIDKKFSAHYDAVEAELKSSTVGLVTLNDMKAKQEALVKEREKQLAKKEQSKELQMKLEKLREKERKKEAKRKISSLSFTLEEEEEGGEEEEEAAMYEEEMEREEITTKKRKLGKNPDVDTSFLPDRDREEEENRLREELRQEWEAKQEKIKSEEIEITFSYWDGSGHRRTVKMRKGNTMQQFLQKALEILRKDFSELRSAGVEQLMYIKED

SEQ ID NO: 3250 - protein, 255 aa, Homo sapiens
MADAEVIILPKKHKKKKERKSLPEEDVAEIQHAEEFLIKPESKVAKLDTSQWPLLLKNFDKLNVRTTHYTPLACGSNPLKREIGDYIRTGFINLDKPSNPSSHEVVAWIRRILRVEKTGHSGTLDPKVTGCLIVCIERATRLVKSQQSAGKEYVGIVRLHNAIEGGTQLSRALETLTGALFQRPPLIAAVKRQLRVRTIYESKMIEYDPERRLGIFWVSCEAGTYIRTLCVHLGLLLGVGGQMQELRRVRSGVMS

SEQ ID NO: 3251 - protein, 255 aa, Homo sapiens
MRSAARRGRAAPAARDSLPVLLFLCLLLKTCEPKTANAFKPNILLIMADDLGTGDLGCYGNNTLRTPNIDQLAEEGVRLTQHLAAAPLCTPSRAAFLTGRHSFRSGMDASNGYRALQWNAGSGGLPENETTFARILQQHGYATGLIGKWHQGVNCASRGDHCHHPLNHGFDYFYGMPFTLTNDCDPGRPPEVDAALRAQLWGYTQFLALGILTLAAGQTCGFFSVSARAVTGMAGVGCLFFISWYSSFGFVRRWN

SEQ ID NO: 3252 - protein, 255 aa, Homo sapiens
MVPGVPGAVLTLCLWLAASSGCLAAGPGAAAARRLDESLSAGSVQRARCASRCLSLQITRISAFFQHFQNNGSLVWCQNHKQCSKCLEPCKESGDLRKHQCQSFCEPLFPKKSYECLTSCEFLKYILLVKQGDCPAPEKASGFAAACVESCEVDNECSGVKKCCSNGCGHTCQVPKTLYKGVPLKPRKELRFTELQSGQLEVKWSSKFNISIEPVIYVVQRRWNYGIHPSEDDATHWQTVAQTTDERVQLTDIRP

SEQ ID NO: 3253 - protein, 255 aa, Homo sapiens
MKYILVTGGVISGIGKGIIASSIGTILKSCGLRVTAIKIDPYINIDAGTFSPYEHGEVFVLNDGGEVDLDLGNYERFLDINLYKDNNITTGKIYQHVINKERRGDYLGKTVQVVPHITDAVQEWVMNQAKVPVDGNKEEPQICVIELGGTIGDIEGMPFVEAFRQFQFKAKRENFCNIHVSLVPQLSATGEQKTKPTQNSVRALRGLGLSPDLIVCRSSTPIEMAVKEKISMFCHVNPEQVICIHDVSSTYRVPV

SEQ ID NO: 3254 - protein, 255 aa, Homo sapiens
MPLAQLADPWQKMAVESPSDSAENGQQIMDEPMGEEEINPQTEEVSIKEIAITHHVKEGHEKADPSQFELLKVLGQGSFGKVFLVKKISGSDARQLYAMKVLKKATLKVRDRVRTKMERDILVEVNHPFIVKLHYAFQTEGKLYLILDFLRGGDLFTRLSKEVMFTEEDVKFYLAELALALDHLHSLGIIYRDLKPENILLDEEGHIKLTDFGLSKESIDHEKKAYSFCGTVEYMAPEVVNRRGHTQSADWWSFG

SEQ ID NO: 3255 - protein, 255 aa, Homo sapiens
MLSATPLYGNVHSWMNSERVRMCGASEDRKILVNDGDASKARLELREENPLNHNVVDASTAHRIDGLAALSMDRTGLIREGLRVPGNIVYSSLCGLGSEKGREAATSTLGGLGFSSERNPEMQFKPNTPETVEASAVSGKPPNGFSAIYKTPPGIQKSAVATAEALGLDRPASDKQSPLNINGASYLRLPWVNPYMEGATPAIYPFLDSPNKYSLNMYKALLPQQSYSLAQPLYSPVCTNGERFLYLPPPHYVGP

SEQ ID NO: 3256 - protein, 169 aa, Homo sapiens
MKGSRIELGDVTPHNIKQLKRLNQVIFPVSYNDKFYKDVLEVGELAKLAYFNDIAVGAVCCRVDHSQNQKRLYIMTLGCLAPYRRLGIGTKMLNHVLNICEKDGTFDNIYLHVQISNESAIDFYRKFGFEIIETKKNYYKRIEPADAHVLQKNLKVPSGQNADVQKTDN

SEQ ID NO: 3257 - protein, 255 aa, Homo sapiens
MAANGDSPPWSPALAAEGRGSSCEASVSFEDVTVDFSKEEWQHLDPAQRRLYWDVTLENYSHLLSVGYQIPKSEAAFKLEQGEGPWMLEGEAPHQSCSGEAIGKMQQQGIPGGIFFHCERFDQPIGEDSLCSILEELWQDNDQLEQRQENQNNLLSHVKVLIKERGYEHKNIEKIIHVTTKLVPSIKRLHNCDTILKHTLNSHNHNRNSATKNLGKIFGNGNNFPHSPSSTKNENAKTGANSCEHDHYEKHLSHK

SEQ ID NO: 3258 - protein, 255 aa, Homo sapiens
MTILPKKKPPPPDADPANEPPPPGPMPPAPRRGGGVGVGGGGTGVGGGDRDRDSGVVGARPRASPPPQGPLPGPPGALHRWALAVPPGAVAGPRPQQASPPPCGGPGGPGGGPGDALGAAAAGVGAAGVVVGVGGAVGVGGCCSGPGHSKRRRQAPGVGAVGGGSPEREEVGAGYNSEDEYEAAAARIEAMDPATVEQQEHWFEKALRDKKGFIIKQMKEDGACLFRAVADQVYGDQDMHEVVRKHCMDYLMKNA

SEQ ID NO: 3259 - protein, 255 aa, Homo sapiens
MAAGLATWLPFARAAAVGWLPLAQQPLPPAPGVKASRGDEVLVVNVSGRRFETWKNTLDRYPDTLLGSSEKEFFYDADSGEYFFDRDPDMFRHVLNFYRTGRLHCPRQECIQAFDEELAFYGLVPELVGDCCLEEYRDRKKENAERLAEDEEAEQAGDGPALPAGSSLRQRLWRAFENPHTSTAALVFYYVTGFFIAVSVIANVVETIPCRGSARRSSREQPCGERFPQAFFCMDTACVLIFTGEYLLRLFAAPS

SEQ ID NO: 3260 - protein, 255 aa, Homo sapiens
MDPSDFPSPFDPLTLPEKPLAGDLPVDMEFGEDLLESQTAPTRGWAPPGPSPSSGALDLLDTPAGLEKDPGVLDGATELLGLGGLLYKAPSPPEVDHGPEGTLAWDAGDQTLEPGPGGQTPEVVPPDPGAGANSCSPEGLLEPLAPDSPITLQSPHIEEEETTSIATARRGSPGQEEELPQGQPQSPNAPPSPSVGETLGDGINSSQTKPGGSSPPAHPSLPGDGLTAKASEKPPERKRSERVRRAEPPKPEVVD

SEQ ID NO: 3261 - protein, 255 aa, Homo sapiens
MRKGKGPICLFSRPTLRPSRSKVSLIEGRGANMAARWRFWCVSVTMVVALLIVCDVPSASAQRKKEMVLSEKVSQLMEWTNKRPVIRMNGDKFRRLVKAPPRNYSVIVMFTALQLHRQCVVCKQADEEFQILANSWRYSSAFTNRIFFAMVDFDEGSDVFQMLNMNSAPTFINFPAKGKPKRGDTYELQVRGFSAEQIARWIADRTDVNIRVIRPPNYAGPLMLGLLLAVIGGLVYLRRSNMEFLFNKTGWAFAA

SEQ ID NO: 3262 - protein, 255 aa, Homo sapiens
MAAAPTQIEAELYYLIARFLQSGPCNKSAQVLVQELEEHQLIPRRLDWEGKEHRRSFEDLVAANAHIPPDYLLKICERIGPLLDKEIPQSVPGVQTLLGVGRQSLLRDAKDCKSTLWNGSAFAALHRGRPPELPVNYVKPPNVVNITSARQLTGCSRFGHIFPSSAYQHIKMHKRILGHLSSVYCVAFDRSGRRIFTGSDDCLVKIWATDDGRLLATLRGHSAEISDMAVNYENTLIAAGSCDKVVRVWCLRTCA

SEQ ID NO: 3263 - protein, 255 aa, Homo sapiens
MAGLKRRVPLHSLRYFISMVGLFSKPGLLPWYARNPPGWSQLFLGTVCKGDFTRVIATKCQKGQKSQKKPSHLGPLDGSWQERLADVVTPLWRLSYEEQLKVKFAAQKKILQRLESYIQMLNGVSVTTAVPKSERLSCLLHPIIPSPVINGYRNKSTFSVNRGPDGNPKTVGFYLGTWRDGNVVCVQSNHLKNIPEKHSQVAQYYEVFLRQSPLEPCLVFHEGGYWRELTVRTNSQGHTMAIITFHPQKLSQEEL

SEQ ID NO: 3264 - protein, 255 aa, Homo sapiens
MQLRNPELHLGCALALRFLALVSWDIPGARALDNGLARTPTMGWLHWERFMCNLDCQEEPDSCISEKLFMEMAELMVSEGWKDAGYEYLCIDDCWMAPQRDSEGRLQADPQRFPHGIRQLANYVHSKGLKLGIYADVGNKTCAGFPGSFGYYDIDAQTFADWGVDLLKFDGCYCDSLENLADGYKHMSLALNRTGRSIVYSCEWPLYMWPFQKPNYTEIRQYCNHWRNFADIDDSWKSIKSILDWTSFNQERIVD

SEQ ID NO: 3265 - protein, 255 aa, Homo sapiens
MSSRKQGSQPRGQQSAEEENFKKPTRSNMQRSKMRGASSGKKTAGPQQKNLEPALPGRWGGRSAENPPSGSVRKTRKNKQKTPGNGDGGSTSEAPQPPRKKRARADPTVESEEAFKNRMEVKVKIPEELKPWLVEDWDLVTRQKQLFQLPAKKNVDAILEEYANCKKSQGNVDNKEYAVNEVVAGIKEYFNVMLGTQLLYKFERPQYAEILLAHPDAPMSQVYGAPHLLRLFVRIGAMLAYTPLDEKSLALLLGY

SEQ ID NO: 3266 - protein, 226 aa, Homo sapiens
MEGCVSNLMVCNLAYSGKLEELKESILADKSLATRTDQDSRTALHWACSAGHTEIVEFLLQLGVPVNDKDDAGWSPLHIAASAGRDEIVKALLGKGAQVNAVNQNGCTPLHYAASKNRHEIAVMLLEGGANPDAKDHYEATAMHRAAAKGNLKMIHILLYYKASTNIQDTEGNTPLHLACDEERVEEAKLLVSQGASIYIENKEEKTPLQVAKGGLGLILKRMVEG

SEQ ID NO: 3267 - protein, 255 aa, Homo sapiens
MKLKLNVLTIILLPVHLLITIYSALIFIPWYFLTNAKKKNAMAKRIKAKPTSDKPGSPYRSVTHFDSLAVIDIPGADTLDKLFDHAVSKFGKKDSLGTREILSEENEMQPNGKVFKKLILGNYKWMNYLEVNRRVNNFGSGLTALGLKPKNTIAIFCETRAEWMIAAQTCFKYNFPLVTLYATLGKEAVVHGLNESEASYLITSVELLESKLKTALLDISCVKHIIYVDNKAINKAEYPEGFEIHSMQSVEELGS

SEQ ID NO: 3268 - protein, 255 aa, Homo sapiens
MVCFRLFPVPGSGLVLVCLVLGAVRSYALELNLTDSENATCLYAKWQMNFTVRYETTNKTYKTVTISDHGTVTYNGSICGDDQNGPKIAVQFGPGFSWIANFTKAASTYSIDSVSFSYNTGDNTTFPDAEDKGILTVDELLAIRIPLNDLFRCNSLSTLEKNDVVQHYWDVLVQAFVQNGTVSTNEFLCDKDKTSTVAPTIHTTVPSPTTTPTPKEKPEAGTYSVNNGNDTCLLATMGLQLNITQDKVASVININ

SEQ ID NO: 3269 - protein, 255 aa, Homo sapiens
MFPTGFSSPSPSAAAAAQEVRSATDGNTSTTPPTSAKKRKLNSSSSSSSNSSNEREDFDSTSSSSSTPPLQPRDSASPSTSSFCLGVSVAASSHVPIQKKLRFEDTLEFVGFDAKMAEESSSSSSSSSPTAATSQQQQLKNKSILISSVASVHHANGLAKSSTTVSSFANSKPGSAKKLVIKNFKDKPKLPENYTDETWQKLKEAVEAIQNSTSIKYNLEELYQAVENLCSYKISANLYKQLRQICEDHIKAQIH

SEQ ID NO: 3270 - protein, 255 aa, Homo sapiens
MEQTDCKPYQPLPKVKHEMDLAYTSSSDESEDGRKPRQSYNSRETLHEYNQELRMNYNSQSRKRKEVEKSTQEMEFCETSHTLCSGYQTDMHSVSRHGYQLEMGSDVDTETEGAASPDHALRMWIRGMKSEHSSCLSSRANSALSLTDTDHERKSDGENGFKFSPVCCDMEAQAGSTQDVQSSPHNQFTFRPLPPPPPPPHACTCARKPPPAADSLQRRSMTTRSQPSPAAPAPPTSTQDSVHLHNSWVLNSNIP

SEQ ID NO: 3271 - protein, 255 aa, Homo sapiens
MAITLQPSDLIFEFASNGMDDDIHQLEDPSVFPAVIVEQVPYPDLLHLYSGLELDDVHNGIITDGTLCMTQDQILEGSFLLTDDNEATSHTMSTAEVLLNMESPSDILDEKQIFSTSEMLPDSDPAPAVTLPNYLFPASEPDALNRAGDTSDQEGHSLEEKASREESAKKTGKSKKRIRKTKGNRSTSPVTDPSIPIRKKSKDGKGSTIYLWEFLLALLQDRNTCPKYIKWTQREKGIFKLVDSKAVSKLWGKQK

SEQ ID NO: 3272 - protein, 183 aa, Homo sapiens
MREYKVVVLGSGGVGKSALTVQFVTGTFIEKYDPTIEDFYRKEIEVDSSPSVLEILDTAGTEQFASMRDLYIKNGQGFILVYSLVNQQSFQDIKPMRDQIVRVKRYEKVPLILVGNKVDLEPEREVMSSEGRALAQEWGCPFMETSAKSKSMVDELFAEIVRQMNYSSLPEKQDQCCTTCVVQ

SEQ ID NO: 3273 - protein, 113 aa, Homo sapiens
MDGRVQLMKALLAGPLRPAARRWRNPIPFPETFDGDTDRLPEFIVQTSSYMFVDENTFSNDALKVTFLITRLTGPALQWVIPYIRKESPLLNDYRGFLAEMKRVFGWEEDEDF

SEQ ID NO: 3274 - protein, 255 aa, Homo sapiens
MNLRGLFQDFNPRAEGETCVEFKAMLIAVGIHLLLLMFEVLVCDRIERGSHFWLLVFMPLFFVSPVSVAACVWGFRHDRSLELEILCSVNILQFIFIALRLDKIIHWPWLVVCVPLWILMSFLCLVVLYYIVWSVLFLRSMDVIAEQRRTHITMALSWMTIVVPLLTFEILLVHKLDGHNAFSCIPIFVPLWLSLITLMATTFGQKGGNHWWFGIRKDFCQFLLEIFPFLREYGNISYDLHHEDNEETEETPVPE

SEQ ID NO: 3275 - protein, 220 aa, Homo sapiens
MNIRNARPEDLMNMQHCNLLCLPENYQMKYYFYHGLSWPQLSYIAEDENGKIVGYVLAKMEEDPDDVPHGHITSLAVKRSHRRLGLAQKLMDQASRAMIENFNAKYVSLHVRKRISEVEPKYYADGEDAYAMKRDLTQMADELRRHLELKEKGRHVVLGAIENKVESKGNSPPSSGEACREEKGLAAEDSGGDSKDLSEVSETTESTDVKDSSEASDSAS

SEQ ID NO: 3276 - protein, 255 aa, Homo sapiens
MAGGPGPGEPAAPGAQHFLYEVPPWVMCRFYKVMDALEPADWCQFAALIVRDQTELRLCERSGQRTASVLWPWINRNARVADLVHILTHLQLLRARDIITAWHPPAPLPSPGTTAPRPSSIPAPAEAEAWSPRKLPSSASTFLSPAFPGSQTHSGPELGLVPSPASLWPPPPSPAPSSTKPGPESSVSLLQGARPFPFCWPLCEISRGTHNFSEELKIGEGGFGCVYRAVMRNTVYAVKRLKENADLEWTAVKQS

SEQ ID NO: 3277 - protein, 255 aa, Homo sapiens [sequence omitted]

SEQ ID NO: 3278 - protein, 665 aa, Homo sapiens
MVEAIVEFDYQAQHDDELTISVGEIITNIRKEDGGWWEGQINGRRGLFPDNFVREIKKEMKKDPLTNKAPEKPLHEVPSGNSLLSSETILRTNKRGERRRRRCQVAFSYLPQNDDELELKVGDIIEVVGEVEEGWWEGVLNGKTGMFPSNFIKELSGESDELGISQDEQLSKSSLRETTGSESDGGDSSSTKSEGANGTVATAAIQPKKVKGVGFGDIFKDKPIKLRPRSIEVENDFLPVEKTIGKKLPATTATPDSSKTEMDSRTKSKDYCKVIFPYEAQNDDELTIKEGDIVTLINKDCIDVGWWEGELNGRRGVFPDNFVKLLPPDFEKEGNRPKKPPPPSAPVIKQGAGTTERKHEIKKIPPERPEMLPNRTEEKERPEREPKLDLQKPSVPAIPPKKPRPPKTNSLSRPGALPPRRPERPVGPLTHTRGDSPKIDLAGSSLSGILDKDLSDRSNDIDLEGFDSVVSSTEKLSHPTTSRPKATGRRPPSQSLTSSSLSSPDIFDSPSPEEDKEEHISLAHRGVDASKKTSKTVTISQVSDNKASLPPKPGTMAAGGGGPAPLSSAAPSPLSSSLGTAGHRANSPSLFGTEGKPKMEPAASSQAAVEELRTQVRELRSIIETMKDQQKREIKQLLSELDEEKKIRLRLQMEVNDIKKALQSK

SEQ ID NO: 3279 - protein, 255 aa, Homo sapiens
MAAAAAAAGAAGSAAPAAAAGAPGSGGAPSGSQGVLIGDRLYSGVLITLENCLLPDDKLRFTPSMSSGLDTDTETDLRVVGCELIQAAGILLRLPQVAMATGQVLFQRFFYTKSFVKHSMEHVSMACVHLASKIEEAPRRIRDVINVFHRLRQLRDKKKPVPLLLDQDYVNLKNQIIKAERRVLKELGFCVHVKHPHKIIVMYLQVLECERNQHLVQTSWNYMNDSLRTDVFVRFQPESIACACIYLAARTLEIP

SEQ ID NO: 3280 - protein, 255 aa, Homo sapiens
MDQSVAIQETLAEGEYCVIAVQGVLCEGDSRQSRLLGLVRYRLEHGGQEHALFLYTHRRMAITGDDVSLDQIVPVSRDFTLEEVSPDGELYILGSDVTVQLDTAELSLVFQLPFGSQTRMFLHEVARACPGFDSATRDPEFLWLSRYRCAELELEMPTPRGCNSALVTWPGYATIGGGGSNFDGLRPNGKGVPMDQSSRGQDKPESLQPRQNKSKSEITDMVRSSTITVSDKAHILSMQKFGLRDTIVKSHLLQK

SEQ ID NO: 3281 - protein, 255 aa, Homo sapiens
MGDHLDLLLGVVLMAGPVFGIPSCSFDGRIAFYRFCNLTQVPQVLNTTERLLLSFNYIRTVTASSFPFLEQLQLLELGSQYTPLTIDKEAFRNLPNLRILDLGSSKIYFLHPDAFQGLFHLFELRLYFCGLSDAVLKDGYFRNLKALTRLDLSKNQIRSLYLHPSFGKLNSLKSIDFSSNQIFLVCEHELEPLQGKTLSFFSLAANSLYSRVSVDWGKCMNPFRNMVLEILDVSGNGWTVDITGNFSNAISKSQA

SEQ ID NO: 3282 - protein, 255 aa, Homo sapiens
MPTLSVFMDVPLAHKLEGSLLKTYKQDDYPNKIFLAYRVCMTNEGHPWVSLVVQKTRLQISQDPSLNYEYLPTMGLKSFIQASLALLFGKHSQAIVENRVGGVHTVGDSGAFQLGVQFLRAWHKDARIVYIISSQKELHGLVFQDMGFTVYEYSVWDPKKLCMDPDILLNVVEQIPHGCVLVMGNIIDCKLTPSGWAKLMSMIKSKQIFPFFDIPCQGLYTSDLEEDTRILQYFVSQGFEFFCSQSLSKNFGIYD

SEQ ID NO: 3283 - protein, 255 aa, Homo sapiens
MAAAGSRKRRLAELTVDEFLASGFDSESESESENSPQAETREAREAARSPDKPGGSPSASRRKGRASEHKDQLSRLKDRDPEFYKFLQENDQSLLNFSDSDSSEEEEGPFHSLPDVLEEASEEEDGAEEGEDGDRVPRGLKGKKNSVPVTVAMVERWKQAAKQRLTPKLFHEVVQAFRAAVATTRGDQESAEANKFQVTDSAAFNALVTFCIRDLIGCLQKLLFGKVAKDSSRMLQPSSSPLWGKLRVDIKAYLG

SEQ ID NO: 3284 - protein, 70 aa, Homo sapiens
MSEKKQPVDLGLLEEDDEFEEFPAEDWAGLDEDEDAHVWEDNWDDDNVEDDFSNQLRAELEKHGYKMETS

The claims defining the invention are as follows:

1. A composition comprising a mixture of a DNA polymerase, whole peripheral blood leukocyte cDNA from a subject with a clinical sign of systemic inflammatory response syndrome (SIRS), wherein the whole peripheral blood leukocyte cDNA comprises a basic leucine zipper transcription factor (BATF) cDNA and a retinitis pigmentosa GTPase regulator interacting protein 1 (RPGRIP1) cDNA and the composition further comprises for each of up to 6 cDNAs, which comprise the BATF cDNA and RPGRIP1 cDNA, (1) two oligonucleotide primers that hybridize to opposite complementary strands of the cDNA, and (2) an oligonucleotide probe that comprises a reporter molecule and that hybridizes to the cDNA, wherein the oligonucleotide probe is a real-time polymerase chain reaction probe.

* * * * *